US012305236B2

(12) United States Patent
Bilsborough et al.

(10) Patent No.: US 12,305,236 B2
(45) Date of Patent: May 20, 2025

(54) METHODS AND SYSTEMS FOR SELECTION AND TREATMENT OF PATIENTS WITH INFLAMMATORY DISEASES

(71) Applicants: CEDARS-SINAI MEDICAL CENTER, Los Angeles, CA (US); PROMETHEUS BIOSCIENCES, INC., San Diego, CA (US)

(72) Inventors: Janine Bilsborough, Simi Valley, CA (US); Dermot P. McGovern, Los Angeles, CA (US); Stephan Targan, Los Angeles, CA (US); Alka Potdar, Cumming, CA (US); Jeffry D. Watkins, Encinitas, CA (US); Cindy T. Dickerson, Encinitas, CA (US)

(73) Assignees: Cedars-Sinai Medical Center, Los Angeles, CA (US); Prometheus Biosciences, Inc., San Diego, CA (US)

( * ) Notice: Subject to any disclaimer, the term of this patent is extended or adjusted under 35 U.S.C. 154(b) by 1073 days.

(21) Appl. No.: 17/051,731

(22) PCT Filed: Apr. 26, 2019

(86) PCT No.: PCT/US2019/029402
§ 371 (c)(1),
(2) Date: Oct. 29, 2020

(87) PCT Pub. No.: WO2019/212899
PCT Pub. Date: Nov. 7, 2019

(65) Prior Publication Data
US 2021/0238684 A1    Aug. 5, 2021

Related U.S. Application Data

(60) Provisional application No. 62/784,179, filed on Dec. 21, 2018, provisional application No. 62/681,557, filed on Jun. 6, 2018, provisional application No. 62/664,720, filed on Apr. 30, 2018.

(51) Int. Cl.
| *C12Q 1/6883* | (2018.01) |
| *A61P 1/00* | (2006.01) |
| *A61P 37/06* | (2006.01) |
| *C07K 16/28* | (2006.01) |
| *A61K 39/00* | (2006.01) |

(52) U.S. Cl.
CPC ............ *C12Q 1/6883* (2013.01); *A61P 1/00* (2018.01); *A61P 37/06* (2018.01); *C07K 16/2875* (2013.01); *A61K 2039/505* (2013.01); *C12Q 2600/106* (2013.01); *C12Q 2600/156* (2013.01)

(58) Field of Classification Search
None
See application file for complete search history.

(56) References Cited

U.S. PATENT DOCUMENTS

| 4,229,447 | A | 10/1980 | Porter |
| 4,476,116 | A | 10/1984 | Anik |
| 4,596,795 | A | 6/1986 | Pitha |
| 4,755,386 | A | 7/1988 | Hsiao et al. |
| 5,011,692 | A | 4/1991 | Fujioka et al. |
| 5,017,381 | A | 5/1991 | Maruyama et al. |
| 5,116,817 | A | 5/1992 | Anik |
| 5,229,135 | A | 7/1993 | Philippon et al. |
| 5,677,430 | A | 10/1997 | Goodwin et al. |
| 5,739,136 | A | 4/1998 | Ellinwood, Jr. et al. |
| 5,837,284 | A | 11/1998 | Mehta et al. |
| 5,840,329 | A | 11/1998 | Bai |
| 5,858,401 | A | 1/1999 | Bhalani et al. |
| 6,391,452 | B1 | 5/2002 | Antonsen et al. |
| 6,652,854 | B2 | 11/2003 | Mohler et al. |
| 6,667,048 | B1 | 12/2003 | Lambert et al. |
| 6,960,563 | B2 | 11/2005 | Egbaria et al. |
| 7,122,183 | B2 | 10/2006 | Mohler et al. |
| 7,273,609 | B2 | 9/2007 | Mohler et al. |
| 9,926,373 | B2 | 3/2018 | Andersen et al. |
| 10,322,174 | B2 | 6/2019 | Bilsborough et al. |
| 10,562,848 | B2 | 2/2020 | Buchwald |
| 2002/0064527 | A1 | 5/2002 | Mohler et al. |

(Continued)

FOREIGN PATENT DOCUMENTS

| CN | 104540521 A | 4/2015 |
| JP | 2005503319 A | 2/2005 |

(Continued)

OTHER PUBLICATIONS

Prometheus Biosciences, Inc. Amendment No. 1 to Form S-1 Registration Statement as filed with the Securities and Exchange Commission on Mar. 8, 2021 (245 pages).
Prometheus Biosciences, Inc. Amendment No. 2 to Form S-1 Registration Statement as filed with the Securities and Exchange Commission on Mar. 11, 2021 (245 pages).
Prometheus Biosciences, Inc. Form 10K Annual Report as filed with the Securities and Exchange Commission on Feb. 28, 2023 (129 pages).
Prometheus Biosciences, Inc. Form 10K Annual Report as filed with the Securities and Exchange Commission on Mar. 9, 2022 (125 pages).

(Continued)

*Primary Examiner* — Brad Duffy
(74) *Attorney, Agent, or Firm* — Wilson Sonsini Goodrich & Rosati

(57) ABSTRACT

Described herein are methods and systems for identifying subjects suitable for treatment with an inhibitor of CD30L activity or expression, such as an anti-CD30L antibody. Methods and systems disclosed herein identify subjects suitable for treatment based on a presence of a genotype that is indicative of a disease or condition in the subject for which an inhibitor of CD30L is a suitable treatment. Exemplary conditions include both Crohns disease and primary sclerosing cholangitis. Compositions used to detect the genotypes described herein, and methods of using them are also provided.

8 Claims, 7 Drawing Sheets

Specification includes a Sequence Listing.

(56) References Cited

U.S. PATENT DOCUMENTS

| | | |
|---|---|---|
| 2006/0194265 A1 | 8/2006 | Morris et al. |
| 2006/0280741 A1 | 12/2006 | Mohler et al. |
| 2008/0003221 A1 | 1/2008 | Podack |
| 2008/0213259 A1 | 9/2008 | Mohler et al. |
| 2008/0233119 A2 | 9/2008 | Podack |
| 2010/0071079 A1 | 3/2010 | Mohler et al. |
| 2012/0003182 A1* | 1/2012 | Abderrahim ......... C12Q 1/6883 424/85.6 |
| 2012/0225427 A1 | 9/2012 | Mallat et al. |
| 2012/0328559 A1 | 12/2012 | Podack et al. |
| 2015/0056182 A1 | 2/2015 | Igawa et al. |
| 2016/0039940 A1 | 2/2016 | Andersen et al. |
| 2017/0166967 A1 | 6/2017 | Rotter et al. |
| 2018/0110855 A1 | 4/2018 | Bilsborough et al. |
| 2018/0298105 A1 | 10/2018 | Andersen et al. |
| 2019/0218309 A1 | 7/2019 | Igawa et al. |

FOREIGN PATENT DOCUMENTS

| | | |
|---|---|---|
| TW | 201105662 A | 2/2011 |
| WO | WO-2013081143 A1 | 6/2013 |
| WO | WO-2013181694 A1 | 12/2013 |
| WO | WO-2017106436 A1 | 6/2017 |
| WO | WO-2019212899 A1 | 11/2019 |

OTHER PUBLICATIONS

Prometheus Biosciences, Inc. Form 10-K/A Annual Report (Amendment No. 1) as filed with the Securities and Exchange Commission on Apr. 28, 2023 (42 pages).

Prometheus Biosciences, Inc. Form S-1 Registration Statement as filed with the Securities and Exchange Commission on Mar. 11, 2021 (4 pages).

European Patent Application No. 19796203.8 Extended European Search Report dated Jan. 14, 2022.

Fava et al.: Association of TNFSF8 Regulatory Variants With Excessive Inflammatory Responses but not Leprosy Per Se. Journal of Infectious Diseases. 211(6):968-977. (2015).

Nakamura et al.: Genome-wide Association Study Identifies TNFSF15 and POU2AF1 as Susceptibility Loci for Primary Biliary Cirrhosis in the Japanese Population. The American Journal of Human Genetics. 91(4):721-728 (2012).

Li et al.: Variants in TRIM22 That Affect NOD2 Signaling Are Associated With Very-Early-Onset Inflammatory Bowel Disease. Gastroenterology; 150(5):1196-1207 (2016).

PCT/US2019/029402 International Search Report and Written Opinion dated Sep. 3, 2019.

PCT/US2019/029402 International Preliminary Report on Patentability dated Nov. 12, 2020.

Prometheus Biosciences, Inc. Form S-1 Registration Statement as filed with the Securities and Exchange Commission on Feb. 19, 2021 (246 pages).

Singh et al. Encyclopedia of Pharmaceutical Technology 2nd Ed. pp. 754-757 (2002).

\* cited by examiner

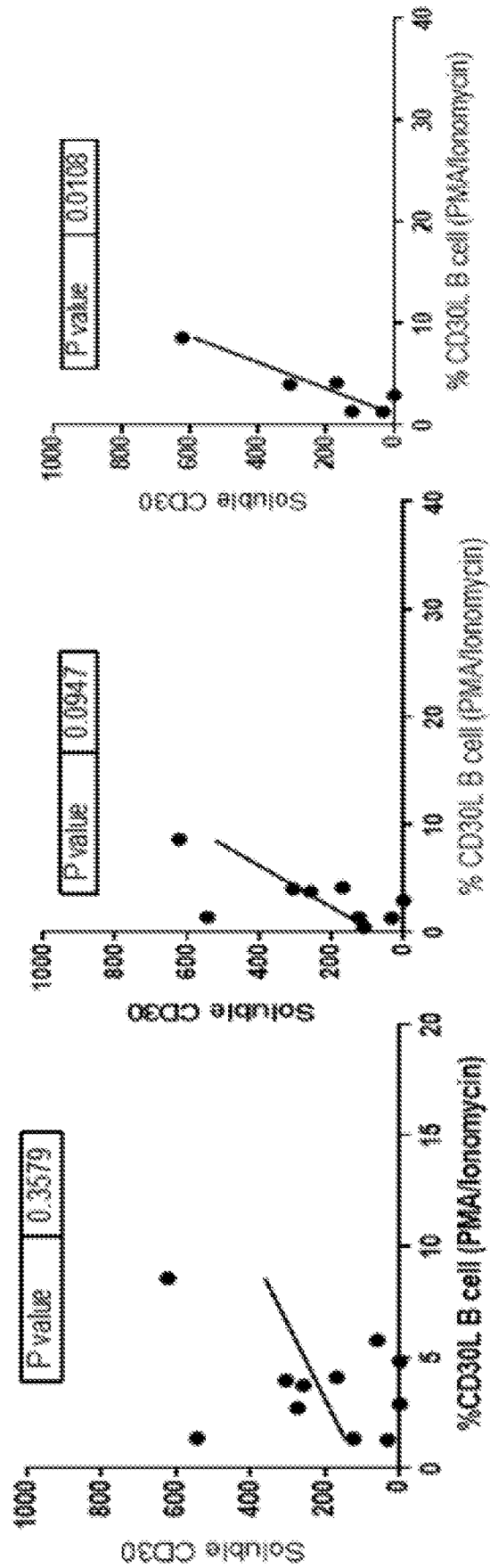

METHODS AND SYSTEMS FOR SELECTION AND TREATMENT OF PATIENTS WITH INFLAMMATORY DISEASES

CROSS-REFERENCE

This application is a U.S. National Stage Application under 35 U.S.C. § 371 of International Patent Application No. of PCT/US2019/029402, filed Apr. 26, 2019, which claims the benefit of U.S. Provisional Application Ser. No. 62/664,720 filed Apr. 30, 2018, U.S. Provisional Application Ser. No. 62/681,557 filed Jun. 6, 2018, and U.S. Provisional Application Ser. No. 62/784,179 filed on Dec. 21, 2018, all of which are incorporated herein by reference in their entirety

SEQUENCE LISTING

The instant application contains a Sequence Listing which has been submitted electronically in ASCII format and is hereby incorporated by reference in its entirety. Said ASCII copy created Apr. 19, 2019, is named 52388-740_601_SL.txt and is 7,862,716 bytes in size.

BACKGROUND

Inflammatory disease, fibrostenotic disease, and fibrotic disease pose a significant health burden worldwide due to the vast number of individuals affected and heterogeneous disease pathogenesis and varied clinical manifestations. One such disease is inflammatory bowel disease (IBD), which has two common forms, Crohn's disease (CD) and ulcerative colitis (UC). IBD is comprises of chronic, relapsing inflammatory disorders of the gastrointestinal tract. Incidences of IBD are prevalent, affecting nearly three million individuals in the United States alone. Each of these forms has various sub-conditions known as subclinical phenotypes that are present in sub-populations of CD and UC patients. One such condition is obstructive Crohn's disease, which can result from long term inflammation that may lead to the formation of scar tissue in the intestinal wall (fibrostenosis) or swelling. Both outcomes can cause narrowing, or obstruction, and are known as either fibrotic or inflammatory strictures. Severe strictures can lead to blockage of the intestine, leading to abdominal pain, bloating, nausea and the inability to pass stool.

Few treatment options are available to patients that suffer from inflammatory disease, fibrostenotic disease, and fibrotic disease. Existing anti-inflammatory therapy such as steroids and tumor necrosis factor (TNF) inhibitors are typically use as a first line treatment for treating IBD. Unfortunately, a significant number of patients experience a lack of response or a loss of response to existing anti-inflammatory therapies, especially TNF inhibitors. While the patient is treated with an anti-inflammatory therapy that is ineffective, the disease worsens. Surgery, in the form of structureplasty (reshaping of the intestine) or resection (removal of the intestine), is the only treatment option for patients that do not respond to first line therapies. Surgical treatments for IBD are invasive, causing post-operative risks for an estimated third of patients undergoing surgery, such as anastomotic leak, infection, and bleeding.

The pathogenesis of inflammatory disease, fibrostenotic disease, and fibrotic disease, like IBD is thought to involve an uncontrolled immune response that may be triggered by certain environmental factors in a genetically susceptible host. The heterogeneity of disease pathogenesis and clinical course, combined with the variable response to treatment and its associated side effects, suggests a personalized medicine approach to treating these diseases is best treatment strategy. Yet there are very few personalized therapies available to patients. Accordingly, there is a need to identify targeted therapeutic approaches for the treatment of inflammatory disease, fibrostenotic disease, and fibrotic disease and subclinical phenotypes thereof, and an even greater need to develop reliable methodology to identifying patients who, based on their genotype, who may respond to any given therapeutic approach. The needed methodologies would also identify subjects not yet diagnosed who are at risk of developing the disease, for which preventative interventions could be prescribed to reduce the growing health burden.

SUMMARY

CD30 ligand (CD30L) is a ligand of CD30 encoded by the gene tumor necrosis factor receptor superfamily 8 or (TNFSF8). CD30L is a member of the tumor necrosis factor superfamily and is important in co-stimulation of immune cells to induce cellular proliferation and cytokine production. In some cases, CD30L acts on proinflammatory cytokines, such as interleukin 6 (IL-6). Preliminary studies suggest that the CD30L pathway is a dominant pathway in the pathogenesis of inflammatory, fibrotic and fibrostenotic disease such as IBD, especially in certain subsets of patients with complicated forms of the disease (e.g., such as stricturing, penetrating, or obstructive disease phenotypes).

Aspects of the present application provide methods and system for treating an inflammatory disease in a subject with an inhibitor of CD30L. In some cases, the CD30L inhibitor inhibits, attenuates, or otherwise interferes with a biological response related to CD30L interaction with its cognate antigen, CD30. Accordingly, in some cases treatment with a CD30L inhibitor is useful to treat conditions with which an expression or activity of CD30 ligand or CD30 are associated.

Also described herein, are polymorphisms and haplotypes thereof at the TNFSF8 gene or genetic locus that are associated with inflammatory, fibrotic or fibrostenotic disease. TNFSF8 polymorphisms may be associated with inflammatory bowel disease (IBD) and various subclinical phenotypes of IBD. In addition, these polymorphisms affect expression of CD30L, and in some cases, CD30. Genotypes comprising the TNFSF8 polymorphisms described herein can be detected in a sample obtained from a subject who may or may not be diagnosed with IBD. Detection of the genotypes, facilitated by existing genotyping assays, can be done at the point of need or in medical health care facility. Exemplary genotyping assays involve hybridization assays using nucleic acid probes specific for said polymorphisms.

Practical applications of the associations between the genotypes described herein and incidences of clinical and subclinical phenotypes in certain populations of individuals are provided herein. For example, the genotypes of the present disclosure can be used to predict a risk that a subject will develop an inflammatory disease, fibrostenotic disease, or a fibrotic disease. The genotypes are also useful to predict whether a patient diagnosed with some form of an inflammatory, fibrotic or fibrostenotic disease will develop a severe form of the disease, such as a subclinical phenotype thereof. In addition, or alternatively, the genotypes disclosed herein are associated with an variation in an expression of CD30 or CD30L, which in some cases, means the genotypes can be used to identify a patient who may be suitable for treatment with a targeted CD30L therapy (e.g., a patient carrying a genotype associated with an increase in CD30L may be suitable for a treatment with an anti-CD30L or anti-CD30 therapy). Exemplary conditions include both Crohn's disease (CD) and primary sclerosing cholangitis. In some cases, a subject is administered a therapeutic agent (e.g., CD30L inhibitor, TL1A inhibitor) provided the genotype disclosed herein is detected in a sample obtained from the subject. A further example of practical applications disclosed herein include laboratory-based methods of detecting the instant genotypes, such as quantitative PCR (qPCR) and sequencing methodologies.

Aspects disclosed herein provide methods of inhibiting or reducing CD30 ligand activity or expression in a subject, the method comprising: (a) selecting a subject having, or suspected of having, at least one of an inflammatory disease, a fibrostenotic disease, and a fibrotic disease; (b) identifying the subject as being a carrier of a genotype comprising a polymorphism at least one of rs911605 and rs1006026; and (c) administering to the subject an effective amount of an inhibitor of CD30 ligand to inhibit or reduce CD30 ligand activity or expression in the subject. In some embodiments, the polymorphism at rs911605 comprises an "A" allele at nucleobase 501 within rs911605 (SEQ ID NO: 1), and wherein the polymorphism at rs1006026 comprises a "G" allele at nucleobase 501 within rs1006026 (SEQ ID NO: 3). In some embodiments, the genotype comprises the polymorphism at rs911605 and the polymorphism at rs1006026. In some embodiments, the polymorphism at rs911605 comprises an "A" allele at nucleobase 501 within rs911605 (SEQ ID NO: 1), and the polymorphism at rs1006026 comprises a "G" allele at nucleobase 501 within rs1006026 (SEQ ID NO: 3). In some embodiments, identifying the subject as being a carrier of the genotype comprises: (a) contacting a sample obtained from the subject comprising genetic material with a nucleic acid sequence capable of hybridizing to at least 10 contiguous nucleobases between nucleobase 400 and nucleobase 600 of at least one of SEQ ID NO: 1 and SEQ ID NO: 3 under standard hybridization conditions, wherein the at least 10 contiguous nucleobases comprises nucleobase at position 501 of the at least one of SEQ ID NO: 1 and SEQ ID NO: 3; and (b) detecting binding between the nucleic acid sequence and the at least 10 contiguous nucleobases between nucleobase 400 and nucleobase 600 of at least one of SEQ ID NO: 1 and SEQ ID NO: 2. In some embodiments, the inhibitor of CD30 ligand is an antibody or an antigen-binding fragment targeting CD30 ligand or CD30, or a combination thereof. In some embodiments, methods further comprise administering to the subject an additional therapeutic agent. In some embodiments, the additional therapeutic agent is a modulator of an expression of a gene or an expression or an activity of a gene expression product, the gene selected from the group consisting of Mitogen-Activated Protein Kinase Kinase Kinase Kinase 4 (MAP4K4), Prostaglandin E Receptor 4 (PTGER4), interleukin 18 receptor 1 (IL18R1). 6-Phosphofructo-2-Kinase/Fructose-2,6-Biphosphatase 3 (PFKFB3), Interleukin 18 Receptor Accessory Protein (IL18RAP), Adenylate Cyclase 7 (ADCY7), B Lymphoid Tyrosine Kinase (BLK), G Protein-Coupled Receptor 65 (GPR65), Sprouty Related EVH1 Domain Containing 2 (SPRED2), Src Kinase Associated Phosphoprotein 2 (SKAP2), Receptor Interacting Serine/Threonine Kinase 2 (RIPK2), and TNF Ligand Superfamily Member 15 (TNFSF15), Janus Kinase 1 (JAK1) G-protein Coupled Receptor 35 (GPR35), and Gasdermin B (GSDMB). In some embodiments, methods further comprise administering to the subject an effective amount of an inhibitor of Tumor Necrosis Factor Ligand Superfamily Member 15 (TL1A). In some embodiments, the inhibitor of TL1A is an antibody or antigen-binding fragment antagonist targeting TL1A. In some embodiments, the antibody or antigen-binding fragment targeting TL1A is provided in Table 15.

Aspects disclosed herein provide methods of treating moderate to severe Crohn's disease in a subject, the method comprising: (a) identifying a subject with Crohn's disease (CD) as being a carrier of a genotype comprising a polymorphism at least one of rs911605 and rs1006026, the genotype associated with a risk that the subject will develop a moderate to severe form of CD comprising obstructive CD; and (b) administering to the subject a therapeutically effective amount of an inhibitor of CD30 ligand activity or expression. In some embodiments, the methods further comprise determining whether the subject has or will develop at least one of a non-response or a loss-of-response to a standard treatment. In some embodiments, the standard treatment is selected from the group consisting of glucocorticosteriods, anti-TNF therapy, anti-a4-b7 therapy (vedolizumab), anti-IL12p40 therapy (ustekinumab), Thalidomide, and Cytoxin. In some embodiments, the polymorphism at rs911605 comprises an "A" allele at nucleobase 501 within rs911605 (SEQ ID NO: 1), and wherein the polymorphism at rs1006026 comprises a "G" allele at nucleobase 501 within rs1006026 (SEQ ID NO: 3). In some embodiments, the genotype comprises the polymorphism at rs911605 and the polymorphism at rs1006026. In some embodiments, the inhibitor of CD30 ligand activity is an antibody or an antigen-binding fragment targeting CD30 ligand or CD30, or a combination thereof. In some embodiments, methods further comprise administering to the subject an additional therapeutic agent. In some embodiments, the additional therapeutic agent is a modulator of an expression of a gene or an expression or an activity of a gene expression product, the gene selected from the group consisting of Mitogen-Activated Protein Kinase Kinase Kinase Kinase 4 (MAP4K4), Prostaglandin E Receptor 4 (PTGER4), interleukin 18 receptor 1 (IL18R1). 6-Phosphofructo-2-Kinase/Fructose-2,6-Biphosphatase 3 (PFK1FB3), Interleukin 18 Receptor Accessory Protein (IL18RAP), Adenylate Cyclase 7 (ADCY7), B Lymphoid Tyrosine Kinase (BLK), G Protein-Coupled Receptor 65 (GPR65), Sprouty Related EVH1 Domain Containing 2 (SPRED2), Src Kinase Associated Phosphoprotein 2 (SKAP2), Receptor Interacting Serine/Threonine Kinase 2 (RIPK2), and TNF Ligand Superfamily Member 15 (TNFSF15), Janus Kinase 1 (JAK1) G-protein Coupled Receptor 35 (GPR35), and Gasdermin B (GSDMB). In some embodiments, methods further comprise administering to the subject an effective amount of an inhibitor of Tumor Necrosis Factor Ligand Superfamily Member 15 (TL1A). In some embodiments, the inhibitor of TL1A is an antibody or antigen-binding fragment antagonist targeting TL1A. In some embodiments, the antibody or antigen-binding fragment targeting TL1A is provided in Table 15.

Aspects disclosed herein provide methods of characterizing an inflammatory disease in a subject, the method comprising: (a) assaying genetic material in a sample obtained from a subject with an inflammatory disease to detect a presence or an absence of a genotype comprising at at least one of rs911605 and a rs1006026; and (b) characterizing the inflammatory disease as a Crohn's disease (CD) provided the presence of the genotype is detected in step (a). In some embodiments, assaying genetic material in a sample of step (a) comprises: (a) amplifying from the genetic material at least 15 nucleobases within SEQ ID NO: 5 or SEQ ID NO: 6, the at least 15 nucleobases comprising a nucleobase at a position indicated by [A/G] in SEQ ID NO: 5 or [A/G] in SEQ ID NO: 6; and (b) hybridizing to the genetic material a nucleic acid comprising a nucleic acid sequence comprising at least one of SEQ ID NO: 5 and SEQ ID NO: 6. In some embodiments, assaying genetic material in a sample of step (a) comprises: (a) amplifying from the genetic material at least 15 nucleobases within SEQ ID NO: 7 or SEQ ID NO: 8, the at least 15 nucleobases comprising a nucleobase at a position indicated by [A/G] in SEQ ID NO: 7 or [A/G] in SEQ ID NO: 8; and (b) hybridizing to the genetic material a nucleic acid comprising a nucleic acid sequence comprising at least one of SEQ ID NO: 7 and SEQ ID NO: 8. In some embodiments, the nucleic acid comprises a detectable molecule. In some embodiments, the methods further comprise administering to the subject an inhibitor of CD30 ligand activity or expression, provided the inflammatory disease is characterized as moderate to severe in step (b). In some embodiments, the inhibitor of CD30 ligand activity is an antibody or an antigen-binding fragment targeting CD30 ligand or CD30, or a combination thereof. In some embodiments, the characterizing the inflammatory disease as CD of step (b) further comprises characterizing the inflammatory disease as refractory to a standard treatment selected from the group consisting of wherein the standard treatment is selected from the group consisting of glucocorticosteriods, anti-TNF therapy, anti-a4-b7 therapy (vedolizumab), anti-IL12p40 therapy (ustekinumab), Thalidomide, and Cytoxin. In some embodiments, the CD is further characterized as obstructive CD. In some embodiments, methods further comprise administering to the subject an additional therapeutic agent. In some embodiments, the additional therapeutic agent is a modulator of an expression of a gene or an expression or an activity of a gene expression product, the gene selected from the group consisting of Mitogen-Activated Protein Kinase Kinase Kinase Kinase 4 (MAP4K4), Prostaglandin E Receptor 4 (PTGER4), interleukin 18 receptor 1 (IL18R1). 6-Phosphofructo-2-Kinase/Fructose-2,6-Biphosphatase 3 (PFKFB3), Interleukin 18 Receptor Accessory Protein (IL18RAP), Adenylate Cyclase 7 (ADCY7), B Lymphoid Tyrosine Kinase (BLK), G Protein-Coupled Receptor 65 (GPR65), Sprouty Related EVH1 Domain Containing 2 (SPRED2), Src Kinase Associated Phosphoprotein 2 (SKAP2), Receptor Interacting Serine/Threonine Kinase 2 (RIPK2), and TNF Ligand Superfamily Member 15 (TNFSF15), Janus Kinase 1 (JAK1) G-protein Coupled Receptor 35 (GPR35), and Gasdermin B (GSDMB). In some embodiments, methods further comprise administering to the subject an effective amount of an inhibitor of Tumor Necrosis Factor Ligand Superfamily Member 15 (TL1A). In some embodiments, the inhibitor of TL1A is an antibody or antigen-binding fragment antagonist targeting TL1A. In some embodiments, the antibody or antigen-binding fragment targeting TL1A is provided in Table 15.

Use of a compound comprising an inhibitor of CD30 ligand to treat a subject identified as being a carrier of a genotype comprising an "A" allele at nucleoposition 501 within SEQ ID NO: 2, a "G" allele at nucleoposition 501 within SEQ ID NO: 4, or a combination thereof. In some embodiments, the subject is identified as having, or susceptible to developing, at least one of a non-response or a loss-of-response to a standard treatment selected from the group consisting of glucocorticosteriods, anti-TNF therapy, anti-a4-b7 therapy (vedolizumab), anti-IL12p40 therapy (ustekinumab), Thalidomide, and Cytoxin.

Use of a combination therapy comprising an inhibitor of CD30 ligand and an inhibitor of Tumor Necrosis Factor Ligand Superfamily Member 15 (TL1A) to treat a subject identified as being a carrier of a genotype comprising an "A" allele at nucleoposition 501 within SEQ ID NO: 2, a "G" allele at nucleoposition 501 within SEQ ID NO: 4, or a combination thereof. In some embodiments, the inhibitor of CD30 ligand and the inhibitor of TL1A are administered to the subject separately. In some embodiments, the subject is identified as having, or susceptible to developing, at least one of a non-response or a loss-of-response to a standard treatment selected from the group consisting of glucocorticosteriods, anti-TNF therapy, anti-a4-b7 therapy (vedolizumab), anti-IL12p40 therapy (ustekinumab), Thalidomide, and Cytoxin. In some embodiments, the inhibitor of TL1A is an antibody or antigen-binding fragment targeting TL1A. In some embodiments, the antibody or antigen-binding fragment targeting TL1A is provided in Table 15.

BRIEF DESCRIPTION OF THE DRAWINGS

FIG. 7A-7C shows risk genotypes rs911605AA and rs1006026 AA/GA/GG (FIG. 7A), rs911605AA and rs1006026 GA/GG (FIG. 7B), and rs911605AA and rs1006026 GG (FIG. 7C), are correlated with levels for sCD30 and the percent of CD30L in B cells.

DETAILED DESCRIPTION OF THE INVENTION

Figure 1:
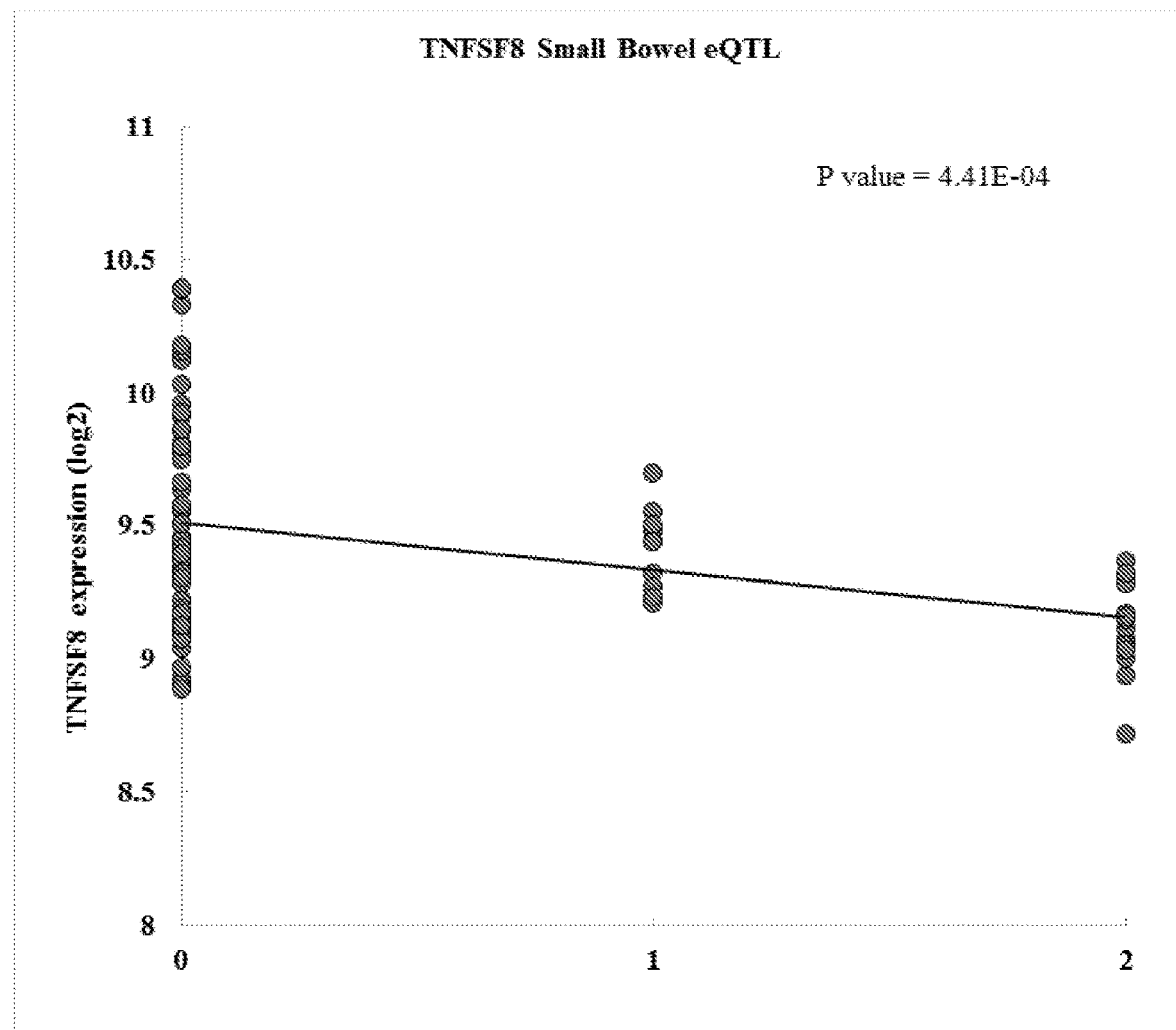
FIG. 1 shows that the risk allele, "A" within rs911605 ($P=4.41 \times 10^{-4}$) (rs911605A or rs911605AA) is associated with increased expression of tumor necrosis factor receptor superfamily 8 (TNFSF8) mRNA in the small bowel using cis-expression quantitative trait loci (cis-eQTL), as compared to individuals who do not carry the risk allele ("non-risk, GG").

The present disclosure provides methods and systems for detecting the presence or absence of a particular genotype in a subject, which in some cases, is useful for selecting subjects for a particular treatment of a certain disease or condition, identifying a risk of developing a clinical or subclinical phenotype, or a combination thereof. In some embodiments, the genotype comprises a polymorphism at rs911605 (SEQ ID NO: 1) and optionally rs1006026 (SEQ ID NO: 3). As an example, the genotype is a haplotype comprising a polymorphism at both rs911605 and rs1006026. In some cases, the presence of the particular genotype indicates that the subject has elevated expression of CD30 ligand (CD30L). In some cases, the presence of the particular genotype indicates that the subject has elevated levels of soluble CD30. In some cases, the presence of the particular genotype indicates that the subject has elevated expression of the tumor necrosis factor (TNF) family cytokine, TL1A (TNFSF15). Accordingly, subjects positive for said genotype may be suitable for treatment with a CD30L inhibitor, such as an anti-CD30L antibody. Subject positive for said genotype may also be suitable for treatment with a TL1A inhibitor. For example, the CD30L inhibitor and the TL1A inhibitor may be useful to treat a disease or condition associated with CD30L/CD30 or TL1A activity, such at least one of an inflammatory disease, fibrostenotic disease, and fibrotic disease. Non-limiting examples of inflammatory diseases include diseases of the gastrointestinal tract, liver, and gallbladder; including Crohn's disease (CD). An exemplary fibrotic disease is primary sclerosing cholangitis (PSC).

In some embodiments, methods and systems are provided for identifying whether or not a subject has a polymorphism at rs911605 and/or rs1006026. In some cases, the polymorphism comprises an "A" allele at position 501 of rs911605 (SEQ ID NO: 2). In some cases, the polymorphism comprises a "G" allele at position 501 of rs1006026 (SEQ ID NO: 4). Exemplary methods include a hybridization assay that comprises contacting genetic material from the subject with a probe comprising a nucleic acid sequence hybridizable to at least a portion (e.g., at least about 10 nucleobases) of a nucleic acid sequence comprising a polymorphism. As an example, a method comprises contacting the genetic material with a probe comprising at least about 10 contiguous nucleobases of rs911605 (SEQ ID NO: 1 or SEQ ID NO: 2), wherein the probe comprises at least the nucleobase at position 501. As another example, a method comprises contacting the genetic material with a probe comprising at least about 10 contiguous nucleobases of rs1006026 (SEQ ID NO: 3 or SEQ ID NO: 4), wherein the probe comprises at least the nucleobase at position 501. Additional probes include those having a sequence that is a reverse complement to those described herein, e.g., a reverse complement to any of SEQ ID NOS: 1-4. In some cases, a method comprises a multiplex assay comprising contacting the genetic material with two or more probes, e.g., one or more probes specific for a polymorphism at rs911605 and one or more probes specific for a polymorphism at rs1006026. Suitable hybridization assays include quantitative polymerase chain reaction (qPCR). For example, the qPCR is a TaqMan™ assay.

Further provided are compositions and kits for detecting the presence of a particular genotype or haplotype, e.g., a polymorphism at rs911605 and/or rs1006026. In some cases, the kits comprise regents such as primers and/or probes configured to amplify and/or detect the genotype from a genetic sample of a subject. In some cases, the kits comprise a sample collection device. Some such devices are useful for obtaining a sample comprising genetic material from a subject. An exemplary collection device is a swab. For use in collecting samples, one method involves contacting the swab to the surface of the subject to be tested, for example, the inner check. Another exemplary collection device is a tube for collection of a blood sample from the subject. In some cases the tube comprises an additive for preservation and/or to facilitate analysis. For example, the tube comprises heparin, potassium oxalate, sodium fluoride, ethylenediaminetetraacetic acid (EDTA), sodium citrate, reagents that activate or reduce clotting, reagents that separate serum, or a combination thereof.

Further provided are CD30L inhibitors and other therapeutic agents, which may be administered to a patient having an inflammatory disease, fibrostenotic disease, and/or fibrotic disease. In some cases the other therapeutic agent may comprise a TL1A inhibitor. A non-limiting example of a CD30L inhibitor is an anti-CD30L antibody, such as the antibodies disclosed elsewhere herein. A non-limiting example of a TL1A inhibitor is an anti-TL1A antibody, such as the antibodies discloses herein. In some embodiments, the patient comprises a genotype disclosed herein, e.g., a polymorphism at rs911605 and/or rs1006026.

Overview

Aspects disclosed herein provide genotypes of a subject. The genotypes may be detected in a sample obtained from the subject by analyzing the genetic material in the sample. The genotypes disclosed herein may be associated with a disease or condition, or a subclinical phenotype of a disease or a condition. The genotypes disclosed herein may be associated with an increase or a decrease in an expression of a gene, or gene expression product expressed from the gene. The genotypes may additionally be associated with a presence of other biomarkers, such as serological markers.

Determining a presence of the genotypes disclosed herein may be useful for at least one of diagnosing, prognosing, monitoring, preventing, and treating a subject with the disease or condition, or subclinical phenotype or symptom thereof. The genotypes disclosed herein may also be useful for identifying subjects that are likely to experience non-response or loss-of-response to a standard treatment, such as a certain first-line therapies (e.g., anti-TNF therapies, steroids, or other immunomodulators). Similarly, the genotypes disclosed herein can be used to identifying subjects that are likely to experience a positive (e.g., therapeutic) response to therapeutic agents or additional therapeutic agents disclosed herein (e.g., anti-TL1A therapy).

Subject

The subject disclosed herein can be a mammal, such as for example a mouse, rat, guinea pig, rabbit, non-human primate, or farm animal. In some instances, the subject is human. In some instances, the subject is a patient who is diagnosed with the disease or condition disclosed herein. In some instances, the subject is not diagnosed with the disease or condition. In some instances, the subject is suffering from a symptom related to a disease or condition disclosed herein (e.g., abdominal pain, cramping, diarrhea, rectal bleeding, fever, weight loss, fatigue, loss of appetite, dehydration, and malnutrition, anemia, or ulcers).

In some embodiments, the subject is susceptible to, or is inflicted with, thiopurine toxicity, or a disease caused by thiopurine toxicity (such as pancreatitis or leukopenia). The subject may experience, or is suspected of experiencing, non-response or loss-of-response to a standard treatment (e.g., anti-TNF alpha therapy, anti-a4-b7 therapy (vedolizumab), anti-IL12p40 therapy (ustekinumab), Thalidomide, or Cytoxin).

Disease or Condition

The disease or condition disclosed herein is at least one of an inflammatory disease, a fibrostenotic disease, and a fibrotic disease. Non-limiting examples of inflammatory diseases include diseases of the gastrointestinal (GI) tract, liver, gallbladder, and joints. In some cases, the inflammatory disease inflammatory bowel disease (IBD), Crohn's disease (CD), or ulcerative colitis, systemic lupus erythematosus (SLE), or rheumatoid arthritis. A subject may suffer from fibrosis, fibrostenosis, or a fibrotic disease, either isolated or in combination with an inflammatory disease. In some cases, the CD is obstructive CD. The obstructive CD may result from inflammation that has led to the formation of scar tissue in the intestinal wall (fibrostenosis) and/or swelling. In some cases, the CD is characterized by the presence of fibrotic and/or inflammatory strictures. The strictures may be determined by computed tomography enterography (CTE), and magnetic resonance imaging enterography (MRE). In some embodiments, the disease is primary sclerosing cholangitis (PSC). Exemplary methods of diagnosing PSC include magnetic resonance cholangiopancreatography (MRCP), liver function tests, and histology. Liver function tests are valuable in the laboratory workup, and may include measurement of levels of serum alkaline phosphatase, serum aminotransferase, gamma glutamyl transpeptidase, and the presence of hypergammaglobulinemia. The disease or condition may comprise thiopurine toxicity, or a disease caused by thiopurine toxicity (such as pancreatitis or leukopenia). In further embodiments provided, the subject experiences non-response to an induction of a therapy, or a loss-of-response to the therapy after a successful induction of the therapy. Non-limiting examples of standard treatment include glucocorticosteriods, anti-TNF therapy, anti-a4-b7 therapy (vedolizumab), anti-IL12p40 therapy (ustekinumab), Thalidomide, and Cytoxin.

Genotypes

Disclosed herein, in some embodiments are genotypes that are detected in a sample obtained from a subject by analyzing the genetic material in the sample. In some instances, the subject may be human. In some embodiments, the genetic material is obtained from a subject having a disease or condition disclosed herein. In some cases, the genetic material is obtained from blood, serum, plasma, sweat, hair, tears, urine, and other techniques known by one of skill in the art. In some cases, the genetic material is obtained for a biopsy, e.g., from the intestinal track of the subject.

The genotypes of the present disclosure comprise genetic material that is deoxyribonucleic acid (DNA). In some instances, the genotype comprises a denatured DNA molecule or fragment thereof. In some instances, the genotype comprises DNA selected from: genomic DNA, viral DNA, mitochondrial DNA, plasmid DNA, amplified DNA, circular DNA, circulating DNA, cell-free DNA, or exosomal DNA. In some instances, the DNA is single-stranded DNA (ssDNA), double-stranded DNA, denaturing double-stranded DNA, synthetic DNA, and combinations thereof. The circular DNA may be cleaved or fragmented.

The genotypes disclosed herein comprise at least one polymorphisms at a gene or genetic locus described herein. In some instances, the gene or genetic locus comprises Tumor Necrosis Factor (Ligand) Superfamily, Member 8 (TNFSF8). In some instances, the gene or genetic locus comprises TNF Superfamily Member 15 (TNFSF15). In some instances, the polymorphism is at a genetic locus that is intergenic, spanning both TNFSF8 and TNFSF15. The genotypes disclosed herein are, in some cases, a haplotype. In some instances, the genotype comprises a particular polymorphism, a polymorphism in linkage disequilibrium (LD) therewith, or a combination thereof. In some cases, LD is defined by an $r^2$ of at least or about 0.70, 0.75, 0.80, 0.85, 0.90, or 0.1. The genotypes disclosed herein can comprise at least or about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more polymorphisms.

The polymorphisms described herein can be a single nucleotide polymorphism, or an indel (insertion/deletion). In some instances, the polymorphism is an insertion or a deletion of at least one nucleobase (e.g., an indel). In some instances, the genotype may comprise a copy number variation (CNV), which is a variation in a number of a nucleic acid sequence between individuals in a given population. In some instances, the CNV comprises at least or about two, three, four, five, six, seven, eight, nine, ten, twenty, thirty, forty or fifty nucleic acid molecules. In some instances, the genotype is heterozygous. In some instances, the genotype is homozygous.

The genotypes presented herein, in some cases, are associated with a presence of a serological marker. A serological marker is a type of biomarker, such as an autoantigen, that represent a serological response to microbial antigens in the body of a subject. Non-limiting examples of serological markers include anti-neutrophil cytoplasmic antibody (ANCA), anti-*Saccharomyces cerevisiae* antibody (ASCA), anti-flagellin (CBir1) antibody, and *E. coli* outer membrane porin protein C (OmpC). The serological markers disclosed herein are useful for patient selection for treatment either alone, or in combination with the genotypes disclosed herein. The serological markers disclosed herein are also useful for the diagnosis, prognosis, prevention, treatment, and/or monitoring of the disease or conditions disclosed herein either alone, or in combination with the genotypes disclosed herein.

In some instances, the genotype comprises one or more polymorphisms at a gene or genetic locus comprising Tumor Necrosis Factor (Ligand) Superfamily, Member 8 (TNFSF8) and/or TNF Superfamily Member 15 (TNFSF15). Disclosed herein, in the following embodiments, are genotypes disclosed herein:

1. A genotype comprising at least one polymorphism at a gene or genetic locus.
2. The genotype of embodiment 1 comprising a polymorphism provided in Table 1, or a polymorphism in linkage disequilibrium (LD) therewith.
3. The genotype of embodiments 1-2 comprising a polymorphism provided in Table 2, or a polymorphism in LD therewith.
4. The genotype of embodiments 1-3 comprising a polymorphism provided in Table 3, or a polymorphism in LD therewith.
5. The genotype of embodiments 1-4 comprising a polymorphism provided in Table 4, or a polymorphism in LD therewith.
6. The genotype of embodiments 1-5 comprising a polymorphism provided in Table 5, or a polymorphism in LD therewith.
7. The genotype of embodiments 1-6 comprising a polymorphism provided in Table 6, or a polymorphism in LD therewith.
8. The genotype of embodiments 1-7 comprising a polymorphism provided in Table 7, or a polymorphism in LD therewith.
9. The genotype of embodiments 1-8 comprising a polymorphism provided in Table 8, or a polymorphism in LD therewith.
10. The genotype of embodiments 1-9 comprising a polymorphism provided in Table 9, or a polymorphism in LD therewith.

11. The genotype of embodiments 1-10 comprising a polymorphism provided in Table 10, or a polymorphism in LD therewith.
12. The genotype of embodiments 1-11 comprising a polymorphism provided in Table 11, or a polymorphism in LD therewith.
13. The genotype of embodiments 1-12 comprising a polymorphism provided in Table 12, or a polymorphism in LD therewith.
14. The genotype of embodiments 1-13 comprising a polymorphism provided in Table 13, or a polymorphism in LD therewith.
15. The genotype of embodiments 1-14 comprising a polymorphism provided in Table 14, or a polymorphism in LD therewith.
16. The genotype of embodiments 1-15 comprising a single nucleotide polymorphism (SNP) at rs911605.
17. The genotype of embodiment 16, wherein the SNP at rs911605 is provided in SEQ ID NO: 1.
18. The genotype of embodiment 16, wherein the SNP at rs911605 comprises an "A" allele at position 501 within SEQ ID NO: 2.
19. The genotype of embodiments 16-18 that is heterozygous.
20. The genotype of embodiments 16-18 that is homozygous.
21. The genotype of embodiments 1-20, comprising a SNP at rs1006026.
22. The genotype of embodiment 21, wherein the SNP at rs1006026 is provided in SEQ ID NO: 3.
23. The genotype of embodiment 21, wherein the SNP at rs100602 comprises a "G" allele at position 501 within SEQ ID NO: 4.
24. The genotype of embodiments 21-23 that is heterozygous.
25. The genotype of embodiments 21-23 that is homozygous Aspects disclosed herein provide genotypes that are associated with, and therefore, indicative of, a subject having or being susceptible (e.g., at risk of) to developing a particular disease or condition, or a subclinical phenotype thereof. Table 1 provides exemplary polymorphisms associated with CD. Table 2 provides exemplary polymorphisms associated with UC. Table 3 provides exemplary polymorphisms associated with IBD. Table 4 provides exemplary polymorphisms associated with anti-TNF loss of response. Table 5 provides exemplary polymorphisms associated with primary sclerosing cholangitis (PSC). Table 6 provides exemplary polymorphisms associated with a presence of ASCA. Table 7 provides exemplary polymorphisms associated with a presence of an antigenic response to Cbir1 flagellin.

TABLE 1

Exemplary Polymorphisms Associated with Crohn's Disease

| rsID | Marker ID | Gene | P Value | Minor Allele (A1) | Odds Ratio (OR) |
|---|---|---|---|---|---|
| rs3181356 | imm_9_116732703 | TNFSF8 | 7.59E−27 | A | 0.127634257 |
| rs13300483 | imm_9_116683183 | TNFSF15, TNFSF8 | 2.51E−25 | A | 0.12110115 |
| rs36118932 | imm_9_116656188 | TNFSF15, TNFSF8 | 2.60E−22 | A | 0.114360729 |
| rs722126 | imm_9_116632599 | TNFSF15, TNFSF8 | 3.16E−22 | C | −0.111625108 |
| rs10982417 | imm_9_116629434 | TNFSF15, TNFSF8 | 1.04E−21 | A | 0.143269521 |
| rs7468800 | imm_9_116631826 | TNFSF15, TNFSF8 | 1.36E−21 | A | 0.144078398 |
| rs7040029 | imm_9_116659035 | TNFSF15, TNFSF8 | 6.42E−21 | A | −0.10768221 |
| rs12238227 | imm_9_116639461 | TNFSF15, TNFSF8 | 9.50E−21 | G | 0.138562685 |
| rs1590256 | imm_9_116633496 | TNFSF15, TNFSF8 | 1.55E−20 | G | 0.137826676 |
| rs1075074 | imm_9_116644067 | TNFSF15, TNFSF8 | 2.56E−20 | G | 0.137110318 |
| rs11554257 | imm_9_116644891 | TNFSF15, TNFSF8 | 3.20E−20 | G | 0.136599802 |
| rs79894446 | imm_9_116642313 | TNFSF15, TNFSF8 | 4.17E−20 | G | 0.136019896 |
| rs10982422 | imm_9_116643604 | TNFSF15, TNFSF8 | 1.02E−19 | G | 0.137892446 |
| rs7866342 | imm_9_116667390 | TNFSF15, TNFSF8 | 8.65E−19 | C | −0.100173651 |
| rs56235203 | imm_9_116642117 | TNFSF15, TNFSF8 | 5.48E−18 | G | 0.129567211 |
| rs10982431 | imm_9_116657387 | TNFSF15, TNFSF8 | 8.00E−17 | A | 0.126908428 |
| rs10982433 | imm_9_116660225 | TNFSF15, TNFSF8 | 1.70E−16 | G | 0.12549274 |
| rs10491581 | imm_9_116649544 | TNFSF15, TNFSF8 | 1.93E−16 | A | 0.1244321 |
| rs2418321 | imm_9_116659868 | TNFSF15, TNFSF8 | 2.00E−16 | A | 0.125155976 |
| rs911605 | imm_9_116694811 | TNFSF8 | 2.00E−16 | G | −0.092651259 |
| rs2145931 | imm_9_116660536 | TNFSF15, TNFSF8 | 2.18E−16 | G | 0.124821487 |
| rs4979464 | imm_9_116641968 | TNFSF15, TNFSF8 | 2.18E−12 | A | −0.113423812 |
| rs10817679 | imm_9_116684461 | TNFSF15, TNFSF8 | 2.96E−11 | G | −0.075090309 |
| rs3181354 | imm_9_116732994 | TNFSF8 | 1.69E−10 | G | −0.075637213 |
| rs77648435 | imm_9_116632040 | TNFSF15, TNFSF8 | 5.29E−10 | A | −0.246629497 |
| rs10982420 | imm_9_116640904 | TNFSF15, TNFSF8 | 7.04E−10 | T | 0.141671941 |
| rs4979474 | imm_9_116735805 | TNFSF8, TNC | 9.07E−10 | A | −0.072804645 |
| rs78044803 | imm_9_116652372 | TNFSF15, TNFSF8 | 1.16E−09 | G | 0.097947954 |
| rs75637575 | imm_9_116678220 | TNFSF15, TNFSF8 | 2.33E−09 | A | 0.095701922 |
| rs2418326 | imm_9_116719295 | TNFSF8 | 2.34E−09 | A | −0.071115395 |
| rs1322063 | imm_9_116625303 | TNFSF15, TNFSF8 | 3.28E−09 | A | −0.09309857 |
| rs2093403 | imm_9_116651734 | TNFSF15, TNFSF8 | 1.27E−08 | G | 0.13347984 |
| rs10982439 | imm_9_116671096 | TNFSF15, TNFSF8 | 1.31E−08 | C | 0.093560592 |
| rs7048073 | imm_9_116669510 | TNFSF15, TNFSF8 | 3.35E−08 | A | −0.063477642 |
| rs10982441 | imm_9_116687420 | TNFSF15, TNFSF8 | 5.89E−08 | A | 0.084213508 |
| rs7874896 | imm_9_116676700 | TNFSF15, TNFSF8 | 1.01E−06 | A | −0.055875108 |
| rs1322055 | imm_9_116709406 | TNFSF8 | 1.33E−06 | G | −0.070949973 |
| rs55768522 | ccc-9-116614041-G-A | TNFSF15, TNFSF8 | 1.90E−06 | A | 0.342392467 |
| rs726657 | imm_9_116736157 | TNFSF8, TNC | 2.03E−06 | A | −0.04971668 |
| rs188254589 | ccc-9-116663100-T-C | TNFSF15, TNFSF8 | 3.49E−06 | G | 0.337693635 |
| rs3181348 | imm_9_116734005 | TNFSF8, TNC | 5.36E−06 | A | −0.047553514 |

TABLE 1-continued

Exemplary Polymorphisms Associated with Crohn's Disease

| rsID | Marker ID | Gene | P Value | Minor Allele (A1) | Odds Ratio (OR) |
|---|---|---|---|---|---|
| rs76779588 | ccc-9-116686804-C-T | TNFSF15, TNFSF8 | 9.46E−06 | A | 0.298183002 |
| rs1322060 | imm_9_116737481 | TNFSF8, TNC | 9.59E−06 | G | −0.046398668 |
| rs2075533 | imm_9_116733452 | TNFSF8 | 1.00E−05 | A | −0.045830075 |
| rs1322057 | imm_9_116618195 | TNFSF15, TNFSF8 | 1.56E−05 | G | 0.276088282 |
| rs113828061 | imm_9_116702567 | TNFSF8 | 1.86E−05 | G | 0.107734992 |
| rs78309793 | imm_9_116657538 | TNFSF15, TNFSF8 | 2.70E−05 | G | 0.128275942 |
| rs111500603 | imm_9_116724035 | TNFSF8 | 2.95E−05 | G | 0.104772658 |
| rs911603 | imm_9_116737405 | TNFSF8, TNC | 5.87E−05 | A | −0.042084774 |
| rs1006026 | imm_9_116731091 | TNFSF8 | 8.18E−05 | G | −0.040653138 |
| rs61024439 | imm_9_116729369 | TNFSF8 | 1.40E−04 | | −0.111953749 |
| rs72756571 | imm_9_116707709 | TNFSF8 | 1.49E−04 | A | −0.076557349 |
| rs7858603 | imm_9_116703091 | TNFSF8 | 1.72E−04 | C | −0.039227671 |
| rs1322059 | imm_9_116736755 | TNFSF8, TNC | 1.91E−04 | A | −0.039524418 |
| rs4979467 | imm_9_116669864 | TNFSF15, TNFSF8 | 2.47E−04 | G | −0.03779018 |
| rs4979466 | imm_9_116669530 | TNFSF15, TNFSF8 | 2.59E−04 | A | −0.037576522 |
| rs7043505 | imm_9_116668349 | TNFSF15, TNFSF8 | 2.59E−04 | G | −0.037570576 |
| rs3181350 | imm_9_116733515 | TNFSF8 | 3.18E−04 | G | −0.101146647 |
| rs3181353 | imm_9_116733321 | TNFSF8 | 3.18E−04 | G | −0.101462878 |
| rs3181349 | imm_9_116733826 | TNFSF8, TNC | 3.18E−04 | G | −0.101484975 |
| rs7854103 | imm_9_116729659 | TNFSF8 | 4.14E−04 | G | −0.099646548 |
| rs7028891 | imm_9_116684836 | TNFSF15, TNFSF8 | 4.18E−04 | A | −0.036313507 |
| rs1108983 | imm_9_116694988 | TNFSF8 | 4.68E−04 | G | −0.09983025 |
| rs10982456 | imm_9_116730579 | TNFSF8 | 4.96E−04 | G | −0.035911392 |
| rs3181359 | imm_9_116731479 | TNFSF8 | 5.11E−04 | A | −0.09768294 |
| rs10982448 | imm_9_116712065 | TNFSF8 | 5.57E−04 | G | −0.097164171 |
| rs10817681 | imm_9_116714071 | TNFSF8 | 6.37E−04 | G | −0.096062622 |
| rs2181033 | imm_9_116737652 | TNFSF8, TNC | 6.40E−04 | G | −0.036268656 |
| rs1407309 | imm_9_116691601 | TNFSF15, TNFSF8 | 8.42E−04 | A | −0.034837869 |
| rs7028089 | imm_9_116717646 | TNFSF8 | 8.88E−04 | A | −0.0934016 |
| rs10982443 | imm_9_116698611 | TNFSF8 | 9.68E−04 | A | −0.09592099 |
| rs6478117 | imm_9_116701965 | TNFSF8 | 1.11E−03 | G | −0.033637202 |
| rs4978611 | imm_9_116717126 | TNFSF8 | 1.17E−03 | C | −0.033462319 |
| rs12352646 | imm_9_116716339 | TNFSF8 | 1.24E−03 | G | −0.033286377 |
| rs3789879 | imm_9_116718057 | TNFSF8 | 1.30E−03 | G | −0.033147358 |
| rs3181372 | imm_9_116705256 | TNFSF8 | 1.31E−03 | G | −0.033040574 |
| rs10817682 | imm_9_116716135 | TNFSF8 | 1.43E−03 | G | −0.032875621 |
| rs1322056 | imm_9_116712581 | TNFSF8 | 1.46E−03 | G | −0.03279674 |
| rs2974 | imm_9_116703993 | TNFSF8 | 1.49E−03 | G | −0.032778163 |
| rs3181197 | imm_9_116707592 | TNFSF8 | 1.56E−03 | G | −0.032616047 |
| rs3181200 | imm_9_116703705 | TNFSF8 | 1.63E−03 | A | −0.032517084 |
| rs2295800 | imm_9_116704032 | TNFSF8 | 1.64E−03 | G | −0.032505519 |
| rs7030090 | imm_9_116702551 | TNFSF8 | 1.65E−03 | A | −0.032464894 |
| rs12347977 | imm_9_116716651 | TNFSF8 | 1.65E−03 | A | −0.032432508 |
| rs12338765 | imm_9_116716654 | TNFSF8 | 1.74E−03 | C | −0.032273895 |
| rs1322054 | imm_9_116709120 | TNFSF8 | 1.76E−03 | G | −0.032245252 |
| rs3181202 | imm_9_116703371 | TNFSF8 | 1.76E−03 | G | −0.032265553 |
| rs3181367 | imm_9_116706499 | TNFSF8 | 1.82E−03 | A | −0.032136873 |
| rs1126711 | imm_9_116705200 | TNFSF8 | 2.10E−03 | G | −0.031701159 |
| rs1322067 | imm_9_116700754 | TNFSF8 | 2.42E−03 | G | −0.031380906 |
| rs4979465 | imm_9_116647990 | TNFSF15, TNFSF8 | 2.48E−03 | G | −0.052829443 |
| rs3181192 | imm_9_116734915 | TNFSF8, TNC | 2.79E−03 | G | −0.089502633 |
| rs10124990 | imm_9_116737111 | TNFSF8, TNC | 3.14E−03 | G | −0.08887894 |
| rs4978612 | imm_9_116731185 | TNFSF8 | 3.34E−03 | A | −0.076419892 |
| rs2181035 | imm_9_116739156 | TNFSF8, TNC | 3.43E−03 | C | 0.054042281 |
| rs10982445 | imm_9_116699512 | TNFSF8 | 4.72E−03 | G | −0.030273569 |
| rs4979469 | imm_9_116680242 | TNFSF15, TNFSF8 | 7.39E−03 | G | −0.028007015 |
| rs7863183 | imm_9_116682239 | TNFSF15, TNFSF8 | 7.49E−03 | A | −0.027845927 |
| rs1006027 | imm_9_116731134 | TNFSF8 | 9.07E−03 | G | −0.027261872 |
| rs4262377 | imm_9_116629395 | TNFSF15, TNFSF8 | 3.04E−03 | A | 1.177 |

TABLE 2

Exemplary Polymorphisms Associated with Ulcerative Colitis

| rsID | Marker ID | Gene | P Value | Minor Allele (A1) | Odds Ratio (OR) |
|---|---|---|---|---|---|
| rs722126 | imm_9_116632599 | TNFSF15, TNFSF8 | 6.28E−25 | C | −0.124288852 |
| rs7040029 | imm_9_116659035 | TNFSF15, TNFSF8 | 3.13E−24 | A | −0.121677726 |
| rs7866342 | imm_9_116667390 | TNFSF15, TNFSF8 | 3.51E−23 | C | −0.117434873 |

TABLE 2-continued

Exemplary Polymorphisms Associated with Ulcerative Colitis

| rsID | Marker ID | Gene | P Value | Minor Allele (A1) | Odds Ratio (OR) |
|---|---|---|---|---|---|
| rs911605 | imm_9_116694811 | TNFSF8 | 1.08E−21 | G | −0.112633828 |
| rs10817679 | imm_9_116684461 | TNFSF15, TNFSF8 | 4.33E−19 | G | −0.104920168 |
| rs10982422 | imm_9_116643604 | TNFSF15, TNFSF8 | 1.07E−12 | G | 0.112703738 |
| rs12238227 | imm_9_116639461 | TNFSF15, TNFSF8 | 1.54E−12 | G | 0.110055694 |
| rs10982417 | imm_9_116629434 | TNFSF15, TNFSF8 | 1.55E−12 | A | 0.111039743 |
| rs11554257 | imm_9_116644891 | TNFSF15, TNFSF8 | 2.32E−12 | G | 0.10911671 |
| rs1075074 | imm_9_116644067 | TNFSF15, TNFSF8 | 3.56E−12 | G | 0.10834721 |
| rs1590256 | imm_9_116633496 | TNFSF15, TNFSF8 | 6.43E−12 | G | 0.107171668 |
| rs79894446 | imm_9_116642313 | TNFSF15, TNFSF8 | 8.16E−12 | G | 0.106433072 |
| rs56235203 | imm_9_116642117 | TNFSF15, TNFSF8 | 9.36E−12 | G | 0.106734123 |
| rs4979464 | imm_9_116641968 | TNFSF15, TNFSF8 | 4.29E−11 | A | −0.109478698 |
| rs7468800 | imm_9_116631826 | TNFSF15, TNFSF8 | 2.31E−11 | A | 0.106186005 |
| rs10982431 | imm_9_116657387 | TNFSF15, TNFSF8 | 2.86E−11 | A | 0.106239658 |
| rs2418321 | imm_9_116659868 | TNFSF15, TNFSF8 | 2.91E−11 | A | 0.106149421 |
| rs10982433 | imm_9_116660225 | TNFSF15, TNFSF8 | 2.97E−11 | G | 0.1061237 |
| rs10491581 | imm_9_116649544 | TNFSF15, TNFSF8 | 5.02E−11 | A | 0.104199308 |
| rs2145931 | imm_9_116660536 | TNFSF15, TNFSF8 | 5.25E−11 | G | 0.104579186 |
| rs1322055 | imm_9_116709406 | TNFSF8 | 8.58E−09 | G | −0.089451367 |
| rs78044803 | imm_9_116652372 | TNFSF15, TNFSF8 | 2.09E−08 | G | 0.093904306 |
| rs10982439 | imm_9_116671096 | TNFSF15, TNFSF8 | 2.25E−08 | C | 0.094938811 |
| rs1322063 | imm_9_116625303 | TNFSF15, TNFSF8 | 2.41E−08 | A | −0.092480947 |
| rs3181370 | imm_9_116705573 | TNFSF8 | 5.87E−08 | G | 0.059022291 |
| rs75637575 | imm_9_116678220 | TNFSF15, TNFSF8 | 6.22E−08 | A | 0.090274047 |
| rs3181368 | imm_9_116705752 | TNFSF8 | 6.26E−08 | T | 0.059078508 |
| rs3181363 | imm_9_116707063 | TNFSF8 | 6.98E−08 | A | 0.058403899 |
| rs7036962 | imm_9_116726972 | TNFSF8 | 9.65E−08 | A | 0.057826974 |
| rs10982450 | imm_9_116721691 | TNFSF8 | 1.06E−07 | A | 0.057594863 |
| rs3181195 | imm_9_116707963 | TNFSF8 | 1.11E−07 | A | 0.057487215 |
| rs10982449 | imm_9_116716362 | TNFSF8 | 1.17E−07 | G | 0.05738555 |
| rs10982454 | imm_9_116726668 | TNFSF8 | 1.31E−07 | A | 0.057186459 |
| rs3181366 | imm_9_116706597 | TNFSF8 | 1.34E−07 | A | 0.057286573 |
| rs7037640 | imm_9_116716752 | TNFSF8 | 1.37E−07 | C | 0.05690751 |
| rs1322058 | imm_9_116724368 | TNFSF8 | 1.48E−07 | A | 0.056938713 |
| rs2208640 | imm_9_116715275 | TNFSF8 | 1.57E−07 | G | 0.056806226 |
| rs10982441 | imm_9_116687420 | TNFSF15, TNFSF8 | 2.05E−07 | A | 0.084120138 |
| rs927373 | imm_9_116715634 | TNFSF8 | 2.41E−07 | A | 0.056233529 |
| rs1006027 | imm_9_116731134 | TNFSF8 | 2.53E−07 | G | 0.05588679 |
| rs10982451 | imm_9_116722313 | TNFSF8 | 2.67E−07 | A | 0.05575479 |
| rs1006025 | imm_9_116731022 | TNFSF8 | 2.90E−07 | A | 0.055607947 |
| rs4979467 | imm_9_116669864 | TNFSF15, TNFSF8 | 5.40E−07 | G | −0.053862029 |
| rs4979466 | imm_9_116669530 | TNFSF15, TNFSF8 | 6.69E−07 | A | −0.053420913 |
| rs7043505 | imm_9_116668349 | TNFSF15, TNFSF8 | 7.36E−07 | G | −0.053219791 |
| rs10817684 | imm_9_116729005 | TNFSF8 | 1.03E−06 | G | 0.053608161 |
| rs4979469 | imm_9_116680242 | TNFSF15, TNFSF8 | 1.13E−06 | G | −0.053410912 |
| rs2181033 | imm_9_116737652 | TNFSF8, TNC | 1.13E−06 | G | 0.05381049 |
| rs7028891 | imm_9_116684836 | TNFSF15, TNFSF8 | 1.25E−06 | A | −0.052006895 |
| rs1126711 | imm_9_116705200 | TNFSF8 | 1.88E−06 | G | 0.050893813 |
| rs12338765 | imm_9_116716654 | TNFSF8 | 1.97E−06 | C | 0.050968529 |
| rs1322054 | imm_9_116709120 | TNFSF8 | 2.05E−06 | G | 0.050887522 |
| rs3181367 | imm_9_116706499 | TNFSF8 | 2.13E−06 | A | 0.050787131 |
| rs12347977 | imm_9_116716651 | TNFSF8 | 2.29E−06 | A | 0.050639613 |
| rs3181197 | imm_9_116707592 | TNFSF8 | 2.30E−06 | G | 0.050629237 |
| rs3789879 | imm_9_116718057 | TNFSF8 | 2.43E−06 | G | 0.050508536 |
| rs10817682 | imm_9_116716135 | TNFSF8 | 2.45E−06 | G | 0.050491689 |
| rs3181372 | imm_9_116705256 | TNFSF8 | 2.48E−06 | G | 0.05030607 |
| rs1322056 | imm_9_116712581 | TNFSF8 | 2.48E−06 | G | 0.050468509 |
| rs7863183 | imm_9_116682239 | TNFSF15, TNFSF8 | 2.95E−06 | A | −0.050783279 |
| rs4978611 | imm_9_116717126 | TNFSF8 | 3.17E−06 | C | 0.049931768 |
| rs12352646 | imm_9_116716339 | TNFSF8 | 3.60E−06 | G | 0.049647868 |
| rs10982445 | imm_9_116699512 | TNFSF8 | 4.37E−06 | G | 0.050226104 |
| rs10982456 | imm_9_116730579 | TNFSF8 | 4.56E−06 | G | 0.049123235 |
| rs1322067 | imm_9_116700754 | TNFSF8 | 4.96E−06 | G | 0.048951815 |
| rs2295800 | imm_9_116704032 | TNFSF8 | 6.85E−06 | G | 0.048236814 |
| rs1322059 | imm_9_116736755 | TNFSF8, TNC | 8.11E−06 | A | 0.049064536 |
| rs1006026 | imm_9_116731091 | TNFSF8 | 8.17E−06 | G | 0.047839556 |
| rs1407309 | imm_9_116691601 | TNFSF15, TNFSF8 | 8.22E−06 | A | 0.048046906 |
| rs911603 | imm_9_116737405 | TNFSF8, TNC | 8.70E−06 | A | 0.048406272 |
| rs6478117 | imm_9_116701965 | TNFSF8 | 9.35E−06 | G | 0.047474288 |
| rs3181202 | imm_9_116703371 | TNFSF8 | 9.67E−06 | G | 0.047414067 |
| rs7030090 | imm_9_116702551 | TNFSF8 | 1.05E−05 | A | 0.047227175 |
| rs2974 | imm_9_116703993 | TNFSF8 | 1.06E−05 | G | 0.047199604 |
| rs10982420 | imm_9_116640904 | TNFSF15, TNFSF8 | 1.08E−05 | T | 0.101283401 |
| rs3181200 | imm_9_116703705 | TNFSF8 | 1.14E−05 | A | 0.047041777 |
| rs1322060 | imm_9_116737481 | TNFSF8, TNC | 2.34E−05 | G | 0.046206866 |

TABLE 2-continued

Exemplary Polymorphisms Associated with Ulcerative Colitis

| rsID | Marker ID | Gene | P Value | Minor Allele (A1) | Odds Ratio (OR) |
|---|---|---|---|---|---|
| rs2075533 | imm_9_116733452 | TNFSF8 | 4.94E−05 | A | 0.043859332 |
| rs7858603 | imm_9_116703091 | TNFSF8 | 5.53E−05 | C | 0.043470883 |
| rs726657 | imm_9_116736157 | TNFSF8, TNC | 6.27E−05 | A | 0.043538058 |
| rs3181348 | imm_9_116734005 | TNFSF8, TNC | 8.14E−05 | A | 0.042756582 |
| rs2093403 | imm_9_116651734 | TNFSF15, TNFSF8 | 8.25E−05 | G | 0.093001054 |
| rs3181371 | imm_9_116705391 | TNFSF8 | 1.19E−04 | C | −0.060937815 |
| rs78309793 | imm_9_116657538 | TNFSF15, TNFSF8 | 2.96E−04 | G | 0.115368127 |
| rs13300483 | imm_9_116683183 | TNFSF15, TNFSF8 | 3.31E−04 | A | 0.044227549 |
| rs3181356 | imm_9_116732703 | TNFSF8 | 5.14E−04 | A | 0.043769254 |
| rs2181035 | imm_9_116739156 | TNFSF8, TNC | 8.84E−04 | C | 0.065107027 |
| rs75801708 | imm_9_116727818 | TNFSF8 | 9.65E−04 | C | −0.098704195 |
| rs36118932 | imm_9_116656188 | TNFSF15, TNFSF8 | 1.11E−03 | A | 0.040562011 |
| rs1012823 | rs1012823 | TNFSF8, TNC | 1.98E−03 | A | −0.047452096 |
| rs873212 | rs873212 | TNFSF8, TNC | 3.02E−03 | G | −0.044799266 |
| rs3181374 | imm_9_116705008 | TNFSF8 | 5.31E−03 | G | 0.043314289 |

TABLE 3

Exemplary Polymorphisms Associated with Inflammatory Bowel Disease

| rsID | Marker ID | Gene | P Value | Minor Allele (A1) | Odds Ratio (OR) |
|---|---|---|---|---|---|
| rs722126 | imm_9_116632599 | TNFSF15, TNFSF8 | 1.57E−37 | C | −0.119719764 |
| rs7040029 | imm_9_116659035 | TNFSF15, TNFSF8 | 1.04E−35 | A | −0.116554847 |
| rs7866342 | imm_9_116667390 | TNFSF15, TNFSF8 | 1.76E−33 | C | −0.110866084 |
| rs911605 | imm_9_116694811 | TNFSF8 | 5.65E−30 | G | −0.104314245 |
| rs10982417 | imm_9_116629434 | TNFSF15, TNFSF8 | 1.29E−26 | A | 0.130969529 |
| rs12238227 | imm_9_116639461 | TNFSF15, TNFSF8 | 7.41E−26 | G | 0.127644848 |
| rs11554257 | imm_9_116644891 | TNFSF15, TNFSF8 | 3.09E−25 | G | 0.125958552 |
| rs7468800 | imm_9_116631826 | TNFSF15, TNFSF8 | 3.31E−25 | A | 0.128474721 |
| rs1590256 | imm_9_116633496 | TNFSF15, TNFSF8 | 3.71E−25 | G | 0.126145147 |
| rs1075074 | imm_9_116644067 | TNFSF15, TNFSF8 | 4.44E−25 | G | 0.126009952 |
| rs10982422 | imm_9_116643604 | TNFSF15, TNFSF8 | 7.04E−25 | G | 0.12768232 |
| rs79894446 | imm_9_116642313 | TNFSF15, TNFSF8 | 1.38E−24 | G | 0.124301292 |
| rs10817679 | imm_9_116684461 | TNFSF15, TNFSF8 | 8.03E−24 | G | −0.092524278 |
| rs56235203 | imm_9_116642117 | TNFSF15, TNFSF8 | 8.86E−23 | G | 0.120769421 |
| rs10982431 | imm_9_116657387 | TNFSF15, TNFSF8 | 1.33E−21 | A | 0.119254366 |
| rs10982433 | imm_9_116660225 | TNFSF15, TNFSF8 | 2.39E−21 | G | 0.118149495 |
| rs10491581 | imm_9_116649544 | TNFSF15, TNFSF8 | 3.17E−21 | A | 0.116967553 |
| rs2418321 | imm_9_116659868 | TNFSF15, TNFSF8 | 3.23E−21 | A | 0.118006471 |
| rs2145931 | imm_9_116660536 | TNFSF15, TNFSF8 | 3.97E−21 | G | 0.117200813 |
| rs4979464 | imm_9_116641968 | TNFSF15, TNFSF8 | 1.15E−19 | A | −0.114761387 |
| rs3181356 | imm_9_116732703 | TNFSF8 | 4.62E−19 | A | 0.087100845 |
| rs13300483 | imm_9_116683183 | TNFSF15, TNFSF8 | 2.97E−18 | A | 0.083307356 |
| rs36118932 | imm_9_116656188 | TNFSF15, TNFSF8 | 4.28E−16 | A | 0.078574343 |
| rs78044803 | imm_9_116652372 | TNFSF15, TNFSF8 | 4.38E−14 | G | 0.099133994 |
| rs1322063 | imm_9_116625303 | TNFSF15, TNFSF8 | 7.77E−14 | A | −0.096179563 |
| rs75637575 | imm_9_116678220 | TNFSF15, TNFSF8 | 1.39E−13 | A | 0.096780433 |
| rs10982439 | imm_9_116671096 | TNFSF15, TNFSF8 | 1.80E−13 | C | 0.09853306 |
| rs10982420 | imm_9_116640904 | TNFSF15, TNFSF8 | 2.42E−12 | T | 0.125825417 |
| rs10982441 | imm_9_116687420 | TNFSF15, TNFSF8 | 4.12E−12 | A | 0.087966244 |
| rs1322055 | imm_9_116709406 | TNFSF8 | 5.44E−12 | G | −0.082925078 |
| rs2093403 | imm_9_116651734 | TNFSF15, TNFSF8 | 1.80E−10 | G | 0.116767675 |
| rs4979467 | imm_9_116669864 | TNFSF15, TNFSF8 | 3.58E−08 | G | −0.046250219 |
| rs4979466 | imm_9_116669530 | TNFSF15, TNFSF8 | 4.23E−08 | A | −0.046002848 |
| rs7043505 | imm_9_116668349 | TNFSF15, TNFSF8 | 4.78E−08 | G | −0.045821602 |
| rs7028891 | imm_9_116684836 | TNFSF15, TNFSF8 | 1.31E−07 | A | −0.044213844 |
| rs78309793 | imm_9_116657538 | TNFSF15, TNFSF8 | 3.07E−07 | G | 0.12769485 |
| rs4979469 | imm_9_116680242 | TNFSF15, TNFSF8 | 2.29E−06 | G | −0.040362537 |
| rs7863183 | imm_9_116682239 | TNFSF15, TNFSF8 | 3.34E−06 | A | −0.039324521 |
| rs77648435 | imm_9_116632040 | TNFSF15, TNFSF8 | 1.19E−05 | A | −0.136437533 |
| rs188254589 | ccc-9-116663100-T-C | TNFSF15, TNFSF8 | 2.06E−05 | G | 0.267708154 |
| rs2181035 | imm_9_116739156 | TNFSF8, TNC | 4.60E−05 | C | 0.062133802 |
| rs113828061 | imm_9_116702567 | TNFSF8 | 6.79E−05 | G | 0.082230618 |
| rs111500603 | imm_9_116724035 | TNFSF8 | 9.74E−05 | G | 0.080126747 |
| rs61024439 | imm_9_116729369 | TNFSF8 | 1.75E−04 | | −0.088365619 |
| rs55768522 | ccc-9-116614041-G-A | TNFSF15, TNFSF8 | 5.14E−04 | A | 0.205902611 |
| rs3181350 | imm_9_116733515 | TNFSF8 | 8.08E−04 | G | −0.075753825 |
| rs3181349 | imm_9_116733826 | TNFSF8, TNC | 8.41E−04 | G | −0.075871707 |

TABLE 3-continued

Exemplary Polymorphisms Associated with Inflammatory Bowel Disease

| rsID | Marker ID | Gene | P Value | Minor Allele (A1) | Odds Ratio (OR) |
|---|---|---|---|---|---|
| rs7854103 | imm_9_116729659 | TNFSF8 | 1.05E−03 | G | −0.074360242 |
| rs7028089 | imm_9_116717646 | TNFSF8 | 1.05E−03 | A | −0.074195743 |
| rs3181353 | imm_9_116733321 | TNFSF8 | 1.19E−03 | G | −0.073433529 |
| rs10982448 | imm_9_116712065 | TNFSF8 | 1.26E−03 | G | −0.073110217 |
| rs3181359 | imm_9_116731479 | TNFSF8 | 1.33E−03 | A | −0.072696701 |
| rs10817681 | imm_9_116714071 | TNFSF8 | 1.33E−03 | G | −0.072723239 |
| rs1322057 | imm_9_116618195 | TNFSF15, TNFSF8 | 1.93E−03 | G | 0.165462824 |
| rs75801708 | imm_9_116727818 | TNFSF8 | 1.94E−03 | C | −0.071444722 |
| rs1108983 | imm_9_116694988 | TNFSF8 | 2.25E−03 | G | −0.070029514 |
| rs10982443 | imm_9_116698611 | TNFSF8 | 2.79E−03 | A | −0.06989849 |
| rs3181354 | imm_9_116732994 | TNFSF8 | 2.80E−03 | G | −0.028629367 |
| rs4979474 | imm_9_116735805 | TNFSF8, TNC | 3.90E−03 | A | −0.02777651 |
| rs4978612 | imm_9_116731185 | TNFSF8 | 4.02E−03 | A | −0.060449565 |
| rs72756571 | imm_9_116707709 | TNFSF8 | 4.80E−03 | A | −0.046369299 |
| rs76779588 | ccc-9-116686804-C-T | TNFSF15, TNFSF8 | 5.18E−03 | A | 0.158651377 |
| rs3181192 | imm_9_116734915 | TNFSF8, TNC | 7.07E−03 | G | −0.064929665 |
| rs2418326 | imm_9_116719295 | TNFSF8 | 7.19E−03 | A | −0.025883892 |
| rs10124990 | imm_9_116737111 | TNFSF8, TNC | 7.83E−03 | G | −0.064440818 |
| rs1853187 | imm_9_116636173 | TNFSF15, TNFSF8 | 8.49E−03 | C | 0.9114 |

TABLE 4

Exemplary Polymorphisms Associated with Anti-TNF Loss-of-Response

| rsID | Marker | Population | Gene | p_value | Minor Allele (A1) | Odds Ratio (OR) |
|---|---|---|---|---|---|---|
| rs113452999 | ccc-9-116715322-T-G | CD | TNFSF8 | 1.31E−03 | C | 3.21321 |
| rs3181347 | imm_9_116734138 | CD | TNFSF8, TNC | 1.31E−03 | A | 3.21321 |
| rs56283201 | ccc-9-116619480-G-C | CD | TNFSF15, TNFSF8 | 4.19E−03 | C | 2.86355 |
| rs111801762 | ccc-9-116621176-C-T | CD | TNFSF15, TNFSF8 | 4.19E−03 | A | 2.86355 |
| rs3181362 | imm_9_116707264 | UC | TNFSF8 | 7.90E−03 | G | 2.65631 |
| rs3181194 | imm_9_116708182 | UC | TNFSF8 | 7.90E−03 | A | 2.65631 |
| rs3789882 | imm_9_116709520 | UC | TNFSF8 | 7.90E−03 | T | 2.65631 |
| rs7868670 | imm_9_116721173 | UC | TNFSF8 | 7.90E−03 | A | 2.65631 |
| rs4978612 | imm_9_116731185 | UC | TNFSF8 | 7.90E−03 | A | 2.65631 |
| rs3181357 | imm_9_116732165 | UC | TNFSF8 | 7.90E−03 | A | 2.65631 |
| rs10982448 | imm_9_116712065 | UC | TNFSF8 | 7.94E−03 | G | 2.65448 |
| rs10817681 | imm_9_116714071 | UC | TNFSF8 | 7.94E−03 | G | 2.65448 |
| rs7854103 | imm_9_116729659 | UC | TNFSF8 | 7.94E−03 | G | 2.65448 |
| rs3181359 | imm_9_116731479 | UC | TNFSF8 | 7.94E−03 | A | 2.65448 |
| rs3181350 | imm_9_116733515 | UC | TNFSF8 | 7.94E−03 | G | 2.65448 |
| rs3181349 | imm_9_116733826 | UC | TNFSF8, TNC | 7.94E−03 | G | 2.65448 |

TABLE 5

Exemplary Polymorphisms Associated with Primary Sclerosing Cholangitis (PSC)

| rsID | Marker | Population | Gene | P Value | Minor Allele (A1) | Odds Ratio (OR) |
|---|---|---|---|---|---|---|
| rs10982441 | imm_9_116687420 | Ulcerative Colitis | TNFSF15, TNFSF8 | 8.08E−03 | A | 4.136 |
| rs5003740 | imm_9_116700422 | Ulcerative Colitis | TNFSF8 | 9.40E−03 | C | 3.041 |

TABLE 6

Exemplary Polymorphisms Associated with a Presence of ASCA

| rsID | Marker | Population | Gene | P Value | Minor Allele (A1) | Odds Ratio (OR) |
|---|---|---|---|---|---|---|
| rs182685517 | ccc-9-116714799-C-A | UC | TNFSF8 | 1.29E-03 | A | 10.3 |

TABLE 7

Exemplary Polymorphisms Associated with a Presence of Cbir1 Antigenic Response

| rsID | Marker | Population | Gene | P Value | Minor Allele (A1) | Odds Ratio (OR) |
|---|---|---|---|---|---|---|
| rs139709462 | ccc-9-116687002-G-A | UC | TNFSF15, TNFSF8 | 3.82E-03 | A | 4.766 |

In one aspect, genotypes are presented herein which are associated with, and therefore, indicative of, a subject having or developing a particular subclinical phenotype of a disease or condition. A subclinical phenotype may be a specific phenotype related to a disease or condition, or metric to measure disease progression that is characteristic of severe or unusual forms of disease. In some instances, the subclinical phenotype is diagnosable. In some instances, the subclinical phenotype is not diagnosable. Non-limiting examples of IBD subclinical phenotypes include, but are not limited to, non-stricturing disease, stricturing disease, stricturing and penetrating disease, perianal Crohn's disease (pCD), defects in Paneth cells, PSC, and development of blood clots (e.g. thrombus). Time to a first surgery, and time to second surgery, are subclinical phenotypes used to identify subjects at risk for severe forms of disease. In the context of inflammatory bowel disease, a time to first surgery may be a time from a symptom of the inflammatory bowel disease to a surgery. The time to first surgery may be a time from first diagnosis of the IBD to a time of a first surgery. The time to second surgery may be a time from a first surgery to the time of a second surgery. The first and/or second surgery may comprise surgery on at least a portion of the gastrointestinal tract of the subject. Non-limiting surgeries include an intestinal resection, colectomy, perianal surgery, and stricturoplasty. The symptom may be a symptom described herein. The portion of the gastrointestinal tract may be selected from the anus, the colon, the large intestine, the small intestine, the stomach, and the esophagus. Table 8 provides exemplary polymorphisms associated with a time to first surgery. Table 9 provides exemplary polymorphisms associated with a time to second surgery. Table 10 provides exemplary polymorphisms associated with various Paneth cell phenotypes. Table 11 provides exemplary SNPs associated with Thrombis development. Table 12 provides exemplary polymorphisms associated with either non-stricturing and non-penetrating disease, or stricturing and penetrating disease in various parts of the small intestine.

TABLE 8

Exemplary Polymorphisms Associated with a Time to First Surgery

| rsID | Marker | Population | Gene | P Value | Minor Allele (A1) | Odds Ratio (OR) |
|---|---|---|---|---|---|---|
| rs77351417 | imm_9_116730128 | CD | TNFSF8 | 4.05E-03 | G | 0.77213 |

TABLE 9

Exemplary Polymorphisms Associated with a Time to Second Surgery

| rsID | Marker | Population | Gene | P Value | Minor Allele (A1) | Odds Ratio (OR) |
|---|---|---|---|---|---|---|
| rs1322055 | imm_9_116709406 | CD | TNFSF8 | 1.57E-03 | G | 1.58918 |
| rs911605 | imm_9_116694811 | CD | TNFSF8 | 5.02E-03 | G | 1.40235 |
| rs7040029 | imm_9_116659035 | CD | TNFSF15, TNFSF8 | 7.09E-03 | A | 1.39763 |

TABLE 9-continued

Exemplary Polymorphisms Associated with a Time to Second Surgery

| rsID | Marker | Population | Gene | P Value | Minor Allele (A1) | Odds Ratio (OR) |
|---|---|---|---|---|---|---|
| rs1322063 | imm_9_116625303 | CD | TNFSF15, TNFSF8 | 7.23E−03 | A | 1.50433 |
| rs7866342 | imm_9_116667390 | CD | TNFSF15, TNFSF8 | 8.65E−03 | C | 1.39205 |
| rs10817679 | imm_9_116684461 | CD | TNFSF15, TNFSF8 | 8.78E−03 | G | 1.38166 |
| rs722126 | imm_9_116632599 | CD | TNFSF15, TNFSF8 | 8.99E−03 | C | 1.38456 |

TABLE 10

Exemplary Polymorphisms Associated with Various Paneth Cell Defects

| rsID | Marker | Population | Gene | Phenotype | P value | Minor Allele (A1) | Odds Ratio (OR) |
|---|---|---|---|---|---|---|---|
| rs145483345 | ccc-9-116723948-G-A | CD | TNFSF8 | Paneth-D0 phenotype | 1.95E−03 | A | −36.99 |
| rs146284283 | ccc-9-116626832-G-T | CD | TNFSF15, TNFSF8 | Paneth-D0 phenotype | 6.07E−03 | A | −23.46 |
| rs145483345 | ccc-9-116723948-G-A | CD | TNFSF8 | Paneth-D1234 phenotype | 1.87E−03 | A | 37.17 |
| rs146284283 | ccc-9-116626832-G-T | CD | TNFSF15, TNFSF8 | Paneth-D1234 phenotype | 5.95E−03 | A | 23.53 |
| rs145483345 | ccc-9-116723948-G-A | CD | TNFSF8 | Paneth-D2 phenotype | 3.09E−07 | A | 37.19 |
| rs55768522 | ccc-9-116614041-G-A | CD | TNFSF15, TNFSF8 | Paneth-D2 phenotype | 2.03E−04 | A | 11.26 |
| rs1322057 | imm_9_116618195 | CD | TNFSF15, TNFSF8 | Paneth-D2 phenotype | 7.45E−04 | G | 8.884 |
| rs146284283 | ccc-9-116626832-G-T | CD | TNFSF15, TNFSF8 | Paneth-D3 phenotype | 7.21E−05 | A | 10.97 |
| rs113828061 | imm_9_116702567 | CD | TNFSF8 | Paneth-D5 phenotype | 4.74E−03 | G | 0.5058 |
| rs111500603 | imm_9_116724035 | CD | TNFSF8 | Paneth-D5 phenotype | 4.74E−03 | G | 0.5058 |

TABLE 11

Exemplary Polymorphisms Associated with Thrombis Development

| rsID | Marker | Population | Gene | P Value | Minor Allele (A1) | Odds Ratio (OR) |
|---|---|---|---|---|---|---|
| rs4979474 | imm_9_116735805 | UC | TNFSF8, TNC | 8.81E−03 | A | 13.27 |
| rs726658 | imm_9_116736087 | UC | TNFSF8, TNC | 8.81E−03 | C | 13.27 |

TABLE 12

Exemplary Polymorphisms Associated with Stricturing and/or Penetrating Disease in Various Disease Locations

| rsID | Marker | Population | Gene | Phenotype | Disease Location | P value | Minor Allele (A1) | Odds Ratio (OR) |
|---|---|---|---|---|---|---|---|---|
| rs55768522 | ccc-9-116614041-G-A | CD | TNFSF15, TNFSF8 | Non-Stricturing/Non-Penetrating | Ileum | 4.03E−03 | A | 2.843 |

TABLE 12-continued

Exemplary Polymorphisms Associated with Stricturing and/or Penetrating Disease in Various Disease Locations

| rsID | Marker | Population | Gene | Phenotype | Disease Location | P value | Minor Allele (A1) | Odds Ratio (OR) |
|---|---|---|---|---|---|---|---|---|
| rs1322057 | imm_9_116618195 | CD | TNFSF15, TNFSF8 | Non-Stricturing/Non-Penetrating | Ileum | 5.15E−03 | G | 2.63 |
| rs55768522 | ccc-9-116614041-G-A | CD | TNFSF15, TNFSF8 | Stricturing and Penetrating | Ileum | 9.43E−03 | A | 2.327 |
| rs55768522 | ccc-9-116614041-G-A | CD | TNFSF15, TNFSF8 | Stricturing and Penetrating | Ileocolonic | 3.61E−03 | A | 2.432 |

CD30, and nucleic acids encoding CD30 (TNFSF8), are characterized by NCBI Entrez Gene ID 944. CD30 is a transmembrane receptor for its ligand, CD30L, each belonging to the tumor necrosis factor (TNF) family. In some embodiments, a presence of a genotype comprising one or more polymorphisms in Table 13, is associated with a decreased level of CD30, as compared to a level of CD30 in an individual who does not have the genotype. In some embodiments, a presence of a genotype comprising one or more polymorphisms in Table 14 is associated with an increase in the level of CD30, as compared to a level of CD30 in an individual who does not have the genotype. In some instances, detection of the genotype associated with the decrease in CD30 in a sample obtained from a subject is indicative that the subject has a decreased level of CD30, as compared to an individual who does not have the genotype. In some instances, detection of the genotype associated with the increase in CD30 in a sample obtained from a subject is indicative that the subject has an increased level of CD30, as compared to an individual who does not have the genotype. An increase or a decrease in CD30 may suggest a corresponding increase or decrease in its ligand, CD30L.

In some instances, the increase or decrease in CD30 or CD30L is expressed as fold-change. "Fold-change," as used herein, refers to a change in a quantity or level of expression of a gene, or gene expression product thereof, from an initial to a final value. Fold-change may be measured over a period of time, or at a single point in time, or a combination thereof. Fold-change may be an increase or a decrease as compared to the initial value. In some embodiments, the gene comprises deoxynucleic ribonucleic acid (DNA). In some embodiments, the gene expression product comprises ribonucleic acid (RNA), or protein, or both. In some embodiments, the RNA comprises messenger RNA (mRNA). In some embodiments, the increase or decrease in CD30 or CD30L fold-change comprises an increase of 1.1-fold, 1.2-fold, 1.3-fold, 1.4-fold, 1.5 fold, 1.6-fold, 1.7-fold, 1.8-fold, 1.9-fold, 2.0-fold, 2.1-fold, 2.2-fold, 2.3-fold, 2.4-fold, 2.5-fold, 2.6-fold, 2.7-fold, 2.8-fold, 2.0-fold, 3.0-fold, 3.1-fold, 3.2-fold, 3.3-fold, 3.4-fold, 3.5-fold, 4-fold, 5-fold, 10-fold, 20-fold, 30-fold, 40-fold, 50-fold, 60-fold, 70-fold, 80-fold, 90-fold, or 100-fold or more between the sample obtained from a subject and an expression of CD30 or CD30L in an individual who does not have the genotype associated with the increase or decrease fold-change.

In some embodiments, the increase or the decrease in CD30 or CD30L in a subject is indicative that the subject has, or will develop, a particular disease or condition. In some instances, a subject having the particular disease or condition that is related to the presence of a genotype associated with increased levels of CD30 or CD30L in the subject is suitable for treatment with an inhibitor of CD30L, such as an anti-CD30L antibody. In some instances, a subject having the particular disease or condition that is related to the presence of a genotype associated with decreased levels of CD30 or CD30L in the subject is suitable for treatment with an agonist of CD30L or CD30.

TABLE 13

Exemplary Polymorphisms Associated with a Decrease in CD30 Expression

| rsID | Marker | Population | Minor Allele (A1) | EQTL Beta | EQTL P Value |
|---|---|---|---|---|---|
| rs1322063 | imm_9_116625303 | CD | A | −0.211522625 | 4.52E−03 |
| rs1322063 | imm_9_116625303 | CD | A | −0.211522625 | 4.52E−03 |
| rs1322063 | imm_9_116625303 | IBD | A | −0.211522625 | 4.52E−03 |
| rs1322063 | imm_9_116625303 | IBD | A | −0.211522625 | 4.52E−03 |
| rs1322063 | imm_9_116625303 | UC | A | −0.211522625 | 4.52E−03 |
| rs1322063 | imm_9_116625303 | UC | A | −0.211522625 | 4.52E−03 |
| rs1322055 | imm_9_116709406 | CD | G | −0.162405569 | 1.59E−02 |
| rs1322055 | imm_9_116709406 | CD | G | −0.162405569 | 1.59E−02 |
| rs1322055 | imm_9_116709406 | IBD | G | −0.162405569 | 1.59E−02 |
| rs1322055 | imm_9_116709406 | UC | G | −0.162405569 | 1.59E−02 |
| rs1322055 | imm_9_116709406 | UC | G | −0.162405569 | 1.59E−02 |
| rs4979464 | imm_9_116641968 | CD | A | −0.162124748 | 3.72E−04 |
| rs4979464 | imm_9_116641968 | IBD | A | −0.162124748 | 3.72E−04 |
| rs4979464 | imm_9_116641968 | IBD | A | −0.162124748 | 3.72E−04 |
| rs1853187 | imm_9_116636173 | IBD | C | −0.162124748 | 3.72E−04 |
| rs4979464 | imm_9_116641968 | UC | A | −0.162124748 | 3.72E−04 |
| rs722126 | imm_9_116632599 | CD | C | −0.161421352 | 5.43E−04 |
| rs722126 | imm_9_116632599 | CD | C | −0.161421352 | 5.43E−04 |

TABLE 13-continued

Exemplary Polymorphisms Associated with a Decrease in CD30 Expression

| rsID | Marker | Population | Minor Allele (A1) | EQTL Beta | EQTL P Value |
|---|---|---|---|---|---|
| rs722126 | imm_9_116632599 | CD | C | −0.161421352 | 5.43E−04 |
| rs722126 | imm_9_116632599 | IBD | C | −0.161421352 | 5.43E−04 |
| rs722126 | imm_9_116632599 | IBD | C | −0.161421352 | 5.43E−04 |
| rs722126 | imm_9_116632599 | UC | C | −0.161421352 | 5.43E−04 |
| rs7040029 | imm_9_116659035 | CD | A | −0.148933465 | 1.78E−03 |
| rs7040029 | imm_9_116659035 | CD | A | −0.148933465 | 1.78E−03 |
| rs7040029 | imm_9_116659035 | CD | A | −0.148933465 | 1.78E−03 |
| rs7040029 | imm_9_116659035 | IBD | A | −0.148933465 | 1.78E−03 |
| rs7040029 | imm_9_116659035 | IBD | A | −0.148933465 | 1.78E−03 |
| rs7040029 | imm_9_116659035 | UC | A | −0.148933465 | 1.78E−03 |
| rs7866342 | imm_9_116667390 | CD | C | −0.1476006 | 1.26E−03 |
| rs7866342 | imm_9_116667390 | CD | C | −0.1476006 | 1.26E−03 |
| rs7866342 | imm_9_116667390 | CD | C | −0.1476006 | 1.26E−03 |
| rs7866342 | imm_9_116667390 | IBD | C | −0.1476006 | 1.26E−03 |
| rs7866342 | imm_9_116667390 | IBD | C | −0.1476006 | 1.26E−03 |
| rs7866342 | imm_9_116667390 | UC | C | −0.1476006 | 1.26E−03 |
| rs10817679 | imm_9_116684461 | CD | G | −0.142641776 | 1.43E−03 |
| rs10817679 | imm_9_116684461 | CD | G | −0.142641776 | 1.43E−03 |
| rs10817679 | imm_9_116684461 | IBD | G | −0.142641776 | 1.43E−03 |
| rs10817679 | imm_9_116684461 | UC | G | −0.142641776 | 1.43E−03 |
| rs911605 | imm_9_116694811 | CD | G | −0.130902603 | 3.26E−03 |
| rs911605 | imm_9_116694811 | CD | G | −0.130902603 | 3.26E−03 |
| rs911605 | imm_9_116694811 | CD | G | −0.130902603 | 3.26E−03 |
| rs911605 | imm_9_116694811 | IBD | G | −0.130902603 | 3.26E−03 |
| rs911605 | imm_9_116694811 | IBD | G | −0.130902603 | 3.26E−03 |
| rs911605 | imm_9_116694811 | UC | G | −0.130902603 | 3.26E−03 |

TABLE 14

Exemplary Polymorphisms Associated with an Increase in CD30 Expression

| rsID | Marker | Population | Minor Allele (A1) | EQTL Beta | EQTL P Value |
|---|---|---|---|---|---|
| rs10982441 | imm_9_116687420 | CD | A | 0.204073843 | 1.09E−03 |
| rs10982441 | imm_9_116687420 | IBD | A | 0.204073843 | 1.09E−03 |
| rs10982441 | imm_9_116687420 | UC | A | 0.204073843 | 1.09E−03 |
| rs10982441 | imm_9_116687420 | UC | A | 0.204073843 | 1.09E−03 |
| rs78044803 | imm_9_116652372 | CD | G | 0.199685925 | 3.17E−03 |
| rs75637575 | imm_9_116678220 | CD | A | 0.199685925 | 3.17E−03 |
| rs78044803 | imm_9_116652372 | IBD | G | 0.199685925 | 3.17E−03 |
| rs75637575 | imm_9_116678220 | IBD | A | 0.199685925 | 3.17E−03 |
| rs78044803 | imm_9_116652372 | UC | G | 0.199685925 | 3.17E−03 |
| rs75637575 | imm_9_116678220 | UC | A | 0.199685925 | 3.17E−03 |
| rs1006027 | imm_9_116731134 | CD | G | 0.155040457 | 1.88E−04 |
| rs1006027 | imm_9_116731134 | UC | G | 0.155040457 | 1.88E−04 |
| rs1006025 | imm_9_116731022 | UC | A | 0.155040457 | 1.88E−04 |
| rs10817684 | imm_9_116729005 | UC | G | 0.155040457 | 1.88E−04 |
| rs1012823 | rs1012823 | UC | A | 0.150728744 | 2.34E−02 |
| rs7036962 | imm_9_116726972 | UC | A | 0.150566068 | 2.59E−04 |
| rs10982450 | imm_9_116721691 | UC | A | 0.150566068 | 2.59E−04 |
| rs10982449 | imm_9_116716362 | UC | G | 0.150566068 | 2.59E−04 |
| rs10982454 | imm_9_116726668 | UC | A | 0.150566068 | 2.59E−04 |
| rs7037640 | imm_9_116716752 | UC | C | 0.150566068 | 2.59E−04 |
| rs1322058 | imm_9_116724368 | UC | A | 0.150566068 | 2.59E−04 |
| rs10982451 | imm_9_116722313 | UC | A | 0.150566068 | 2.59E−04 |
| rs5003740 | imm_9_116700422 | UC | C | 0.149663166 | 5.95E−03 |
| rs873212 | rs873212 | UC | G | 0.14907519 | 2.38E−02 |
| rs2208640 | imm_9_116715275 | UC | G | 0.148177117 | 2.90E−04 |
| rs927373 | imm_9_116715634 | UC | A | 0.148177117 | 2.90E−04 |
| rs3181363 | imm_9_116707063 | UC | A | 0.146548583 | 3.18E−04 |
| rs3181195 | imm_9_116707963 | UC | A | 0.146548583 | 3.18E−04 |
| rs3181366 | imm_9_116706597 | UC | A | 0.146548583 | 3.18E−04 |
| rs1006026 | imm_9_116731091 | CD | G | 0.146020987 | 1.76E−04 |
| rs1006026 | imm_9_116731091 | UC | G | 0.146020987 | 1.76E−04 |
| rs10491581 | imm_9_116649544 | CD | A | 0.137101352 | 2.81E−02 |
| rs10491581 | imm_9_116649544 | CD | A | 0.137101352 | 2.81E−02 |
| rs10491581 | imm_9_116649544 | IBD | A | 0.137101352 | 2.81E−02 |
| rs10491581 | imm_9_116649544 | IBD | A | 0.137101352 | 2.81E−02 |
| rs10491581 | imm_9_116649544 | UC | A | 0.137101352 | 2.81E−02 |
| rs3181197 | imm_9_116707592 | CD | G | 0.136412498 | 3.62E−04 |
| rs3181197 | imm_9_116707592 | UC | G | 0.136412498 | 3.62E−04 |

TABLE 14-continued

Exemplary Polymorphisms Associated with an Increase in CD30 Expression

| rsID | Marker | Population | Minor Allele (A1) | EQTL Beta | EQTL P Value |
|---|---|---|---|---|---|
| rs10982431 | imm_9_116657387 | CD | A | 0.133827819 | 3.27E−02 |
| rs10982433 | imm_9_116660225 | CD | G | 0.133827819 | 3.27E−02 |
| rs2418321 | imm_9_116659868 | CD | A | 0.133827819 | 3.27E−02 |
| rs2145931 | imm_9_116660536 | CD | G | 0.133827819 | 3.27E−02 |
| rs10982431 | imm_9_116657387 | CD | A | 0.133827819 | 3.27E−02 |
| rs2145931 | imm_9_116660536 | CD | G | 0.133827819 | 3.27E−02 |
| rs10982433 | imm_9_116660225 | CD | G | 0.133827819 | 3.27E−02 |
| rs2418321 | imm_9_116659868 | CD | A | 0.133827819 | 3.27E−02 |
| rs10982431 | imm_9_116657387 | IBD | A | 0.133827819 | 3.27E−02 |
| rs10982433 | imm_9_116660225 | IBD | G | 0.133827819 | 3.27E−02 |
| rs2418321 | imm_9_116659868 | IBD | A | 0.133827819 | 3.27E−02 |
| rs2145931 | imm_9_116660536 | IBD | G | 0.133827819 | 3.27E−02 |
| rs10982431 | imm_9_116657387 | IBD | A | 0.133827819 | 3.27E−02 |
| rs2145931 | imm_9_116660536 | IBD | G | 0.133827819 | 3.27E−02 |
| rs10982433 | imm_9_116660225 | IBD | G | 0.133827819 | 3.27E−02 |
| rs10982431 | imm_9_116657387 | UC | A | 0.133827819 | 3.27E−02 |
| rs2418321 | imm_9_116659868 | UC | A | 0.133827819 | 3.27E−02 |
| rs10982433 | imm_9_116660225 | UC | G | 0.133827819 | 3.27E−02 |
| rs2145931 | imm_9_116660536 | UC | G | 0.133827819 | 3.27E−02 |
| rs10982456 | imm_9_116730579 | CD | G | 0.132394585 | 6.37E−04 |
| rs10982456 | imm_9_116730579 | UC | G | 0.132394585 | 6.37E−04 |
| rs10982417 | imm_9_116629434 | CD | A | 0.129515142 | 3.46E−02 |
| rs10982417 | imm_9_116629434 | CD | A | 0.129515142 | 3.46E−02 |
| rs4262377 | imm_9_116629395 | CD | A | 0.129515142 | 3.46E−02 |
| rs10982417 | imm_9_116629434 | IBD | A | 0.129515142 | 3.46E−02 |
| rs10982417 | imm_9_116629434 | IBD | A | 0.129515142 | 3.46E−02 |
| rs10982417 | imm_9_116629434 | UC | A | 0.129515142 | 3.46E−02 |
| rs4978611 | imm_9_116717126 | CD | C | 0.129252555 | 8.07E−04 |
| rs12352646 | imm_9_116716339 | CD | G | 0.129252555 | 8.07E−04 |
| rs3789879 | imm_9_116718057 | CD | G | 0.129252555 | 8.07E−04 |
| rs10817682 | imm_9_116716135 | CD | G | 0.129252555 | 8.07E−04 |
| rs12347977 | imm_9_116716651 | CD | A | 0.129252555 | 8.07E−04 |
| rs12338765 | imm_9_116716654 | CD | C | 0.129252555 | 8.07E−04 |
| rs12338765 | imm_9_116716654 | UC | C | 0.129252555 | 8.07E−04 |
| rs12347977 | imm_9_116716651 | UC | A | 0.129252555 | 8.07E−04 |
| rs3789879 | imm_9_116718057 | UC | G | 0.129252555 | 8.07E−04 |
| rs10817682 | imm_9_116716135 | UC | G | 0.129252555 | 8.07E−04 |
| rs4978611 | imm_9_116717126 | UC | C | 0.129252555 | 8.07E−04 |
| rs12352646 | imm_9_116716339 | UC | G | 0.129252555 | 8.07E−04 |
| rs12238227 | imm_9_116639461 | CD | G | 0.129225953 | 3.75E−02 |
| rs11554257 | imm_9_116644891 | CD | G | 0.129225953 | 3.75E−02 |
| rs12238227 | imm_9_116639461 | CD | G | 0.129225953 | 3.75E−02 |
| rs11554257 | imm_9_116644891 | CD | G | 0.129225953 | 3.75E−02 |
| rs12238227 | imm_9_116639461 | IBD | G | 0.129225953 | 3.75E−02 |
| rs11554257 | imm_9_116644891 | IBD | G | 0.129225953 | 3.75E−02 |
| rs12238227 | imm_9_116639461 | IBD | G | 0.129225953 | 3.75E−02 |
| rs12238227 | imm_9_116639461 | UC | G | 0.129225953 | 3.75E−02 |
| rs11554257 | imm_9_116644891 | UC | G | 0.129225953 | 3.75E−02 |
| rs1322056 | imm_9_116712581 | CD | G | 0.127900871 | 8.57E−04 |
| rs1322067 | imm_9_116700754 | CD | G | 0.127669396 | 8.80E−04 |
| rs1322067 | imm_9_116700754 | UC | G | 0.127669396 | 8.80E−04 |
| rs7858603 | imm_9_116703091 | CD | C | 0.126301345 | 9.36E−04 |
| rs1407309 | imm_9_116691601 | CD | A | 0.126301345 | 9.36E−04 |
| rs2974 | imm_9_116703993 | CD | G | 0.126301345 | 9.36E−04 |
| rs3181200 | imm_9_116703705 | CD | A | 0.126301345 | 9.36E−04 |
| rs2295800 | imm_9_116704032 | CD | G | 0.126301345 | 9.36E−04 |
| rs7030090 | imm_9_116702551 | CD | A | 0.126301345 | 9.36E−04 |
| rs1322054 | imm_9_116709120 | CD | G | 0.126301345 | 9.36E−04 |
| rs3181202 | imm_9_116703371 | CD | G | 0.126301345 | 9.36E−04 |
| rs3181367 | imm_9_116706499 | CD | A | 0.126301345 | 9.36E−04 |
| rs1322054 | imm_9_116709120 | UC | G | 0.126301345 | 9.36E−04 |
| rs3181367 | imm_9_116706499 | UC | A | 0.126301345 | 9.36E−04 |
| rs2295800 | imm_9_116704032 | UC | G | 0.126301345 | 9.36E−04 |
| rs1407309 | imm_9_116691601 | UC | A | 0.126301345 | 9.36E−04 |
| rs3181202 | imm_9_116703371 | UC | G | 0.126301345 | 9.36E−04 |
| rs7030090 | imm_9_116702551 | UC | A | 0.126301345 | 9.36E−04 |
| rs2974 | imm_9_116703993 | UC | G | 0.126301345 | 9.36E−04 |
| rs3181200 | imm_9_116703705 | UC | A | 0.126301345 | 9.36E−04 |
| rs7858603 | imm_9_116703091 | UC | C | 0.126301345 | 9.36E−04 |
| rs1590256 | imm_9_116633496 | CD | G | 0.125863337 | 4.34E−02 |
| rs1075074 | imm_9_116644067 | CD | G | 0.125863337 | 4.34E−02 |
| rs79894446 | imm_9_116642313 | CD | G | 0.125863337 | 4.34E−02 |
| rs1590256 | imm_9_116633496 | CD | G | 0.125863337 | 4.34E−02 |
| rs79894446 | imm_9_116642313 | CD | G | 0.125863337 | 4.34E−02 |
| rs1075074 | imm_9_116644067 | CD | G | 0.125863337 | 4.34E−02 |

TABLE 14-continued

Exemplary Polymorphisms Associated with an Increase in CD30 Expression

| rsID | Marker | Population | Minor Allele (A1) | EQTL Beta | EQTL P Value |
|---|---|---|---|---|---|
| rs1590256 | imm_9_116633496 | IBD | G | 0.125863337 | 4.34E−02 |
| rs1075074 | imm_9_116644067 | IBD | G | 0.125863337 | 4.34E−02 |
| rs79894446 | imm_9_116642313 | IBD | G | 0.125863337 | 4.34E−02 |
| rs1075074 | imm_9_116644067 | UC | G | 0.125863337 | 4.34E−02 |
| rs1590256 | imm_9_116633496 | UC | G | 0.125863337 | 4.34E−02 |
| rs79894446 | imm_9_116642313 | UC | G | 0.125863337 | 4.34E−02 |
| rs6478117 | imm_9_116701965 | CD | G | 0.122173306 | 1.31E−03 |
| rs3181372 | imm_9_116705256 | CD | G | 0.122173306 | 1.31E−03 |
| rs1126711 | imm_9_116705200 | CD | G | 0.122173306 | 1.31E−03 |
| rs1126711 | imm_9_116705200 | UC | G | 0.122173306 | 1.31E−03 |
| rs3181372 | imm_9_116705256 | UC | G | 0.122173306 | 1.31E−03 |
| rs6478117 | imm_9_116701965 | UC | G | 0.122173306 | 1.31E−03 |
| rs1322059 | imm_9_116736755 | CD | A | 0.112099648 | 9.12E−03 |
| rs1322059 | imm_9_116736755 | UC | A | 0.112099648 | 9.12E−03 |
| rs2181033 | imm_9_116737652 | CD | G | 0.109173017 | 1.26E−02 |
| rs2181033 | imm_9_116737652 | UC | G | 0.109173017 | 1.26E−02 |
| rs726657 | imm_9_116736157 | CD | A | 0.101249648 | 1.29E−02 |
| rs726657 | imm_9_116736157 | UC | A | 0.101249648 | 1.29E−02 |
| rs1322060 | imm_9_116737481 | CD | G | 0.097637655 | 1.78E−02 |
| rs1322060 | imm_9_116737481 | UC | G | 0.097637655 | 1.78E−02 |
| rs3181348 | imm_9_116734005 | CD | A | 0.086202353 | 3.14E−02 |
| rs2075533 | imm_9_116733452 | CD | A | 0.086202353 | 3.14E−02 |
| rs2075533 | imm_9_116733452 | UC | A | 0.086202353 | 3.14E−02 |
| rs3181348 | imm_9_116734005 | UC | A | 0.086202353 | 3.14E−02 |
| rs911603 | imm_9_116737405 | CD | A | 0.083229479 | 4.14E−02 |
| rs911603 | imm_9_116737405 | UC | A | 0.083229479 | 4.14E−02 |

In some embodiments, the genotype is homozygous, which means two copies of the same allele at the same SNP are present. In some embodiments, the genotype is heterozygous, which means one copy of the allele at the same SNP is present. In some embodiments, the genotype comprises a polymorphism at rs911605 (SEQ ID NO: 1). For example, the genotype comprises an "A" allele at position 501 within rs911605, as indicated by SEQ ID NO: 2. In some cases, a subject having this genotype is homozygous for the "A" allele (rs911605AA). In some cases, a subject having this genotype is heterozygous (rs911605A). In some embodiments, the genotype comprises a polymorphism at rs1006026 (SEQ ID NO: 3). For example, the genotype comprises a "G" allele at position 501 within rs1006026, as indicated by SEQ ID NO: 4. In some cases, a subject having this genotype is homozygous for the "G" allele (rs1006026GG). In some cases, a subject having this genotype is heterozygous (rs1006026G).

Further provided is a haplotype comprising a polymorphism at rs911605 (SEQ ID NO: 1) and a polymorphism at rs1006026 (SEQ ID NO: 3). A "haplotype," as used herein refers, in some instances, to a set of polymorphisms that tend to be inherited together. In some cases, the polymorphism at rs911605 comprises an "A" allele at position 501 within rs911605, as indicated by SEQ ID NO: 2. In some cases, the polymorphism at rs1006026 comprises a "G" allele at position 501 within rs1006026, as indicated by SEQ ID NO: 4. In some cases, the haplotype comprises rs911605AA and rs1006026GG.

Methods
Methods of Detecting a Genotype

Methods disclosed herein for detecting a genotype in a sample from a subject comprise analyzing the genetic material in the sample to detect at least one of a presence, an absence, and a quantity of a nucleic acid sequence encompassing the genotype of interest. In some cases, the nucleic acid sequence comprises DNA. In some instances, the nucleic acid sequence comprises a denatured DNA molecule or fragment thereof. In some instances, the nucleic acid sequence comprises DNA selected from: genomic DNA, viral DNA, mitochondrial DNA, plasmid DNA, amplified DNA, circular DNA, circulating DNA, cell-free DNA, or exosomal DNA. In some instances, the DNA is single-stranded DNA (ssDNA), double-stranded DNA, denaturing double-stranded DNA, synthetic DNA, and combinations thereof. The circular DNA may be cleaved or fragmented. In some instances, the nucleic acid sequence comprises RNA. In some instances, the nucleic acid sequence comprises fragmented RNA. In some instances, the nucleic acid sequence comprises partially degraded RNA. In some instances, the nucleic acid sequence comprises a microRNA or portion thereof. In some instances, the nucleic acid sequence comprises an RNA molecule or a fragmented RNA molecule (RNA fragments) selected from: a microRNA (miRNA), a pre-miRNA, a pri-miRNA, a mRNA, a pre-mRNA, a viral RNA, a viroid RNA, a virusoid RNA, circular RNA (circRNA), a ribosomal RNA (rRNA), a transfer RNA (tRNA), a pre-tRNA, a long non-coding RNA (lncRNA), a small nuclear RNA (snRNA), a circulating RNA, a cell-free RNA, an exosomal RNA, a vector-expressed RNA, an RNA transcript, a synthetic RNA, and combinations thereof.

Nucleic acid-based detection techniques that may be useful for the methods herein include quantitative polymerase chain reaction (qPCR), gel electrophoresis, immunochemistry, in situ hybridization such as fluorescent in situ hybridization (FISH), cytochemistry, and next generation sequencing. In some embodiments, the methods involve TaqMan™ qPCR, which involves a nucleic acid amplification reaction with a specific primer pair, and hybridization of the amplified nucleic acids with a hydrolysable probe specific to a target nucleic acid. The present disclosure provides exemplary probes that are hybridizable to a target nucleic acid sequence within rs911605. The present disclosure also provides exemplary probes that are hybridizable to a target nucleic acid sequence within rs1006026.

In some instances, the methods involve hybridization and/or amplification assays that include, but are not limited to, Southern or Northern analyses, polymerase chain reaction analyses, and probe arrays. Non-limiting amplification reactions include, but are not limited to, qPCR, self-sustained sequence replication, transcriptional amplification system, Q-Beta Replicase, rolling circle replication, or any other nucleic acid amplification known in the art. As discussed, reference to qPCR herein includes use of TaqMan™ methods. An additional exemplary hybridization assay includes the use of nucleic acid probes conjugated or otherwise immobilized on a bead, multi-well plate, or other substrate, wherein the nucleic acid probes are configured to hybridize with a target nucleic acid sequence of a genotype provided herein. A non-limiting method is one employed in Anal Chem. 2013 Feb. 5; 85(3):1932-9.

In some embodiments, detecting the presence or absence of a genotype comprises sequencing genetic material from the subject. Sequencing can be performed with any appropriate sequencing technology, including but not limited to single-molecule real-time (SMRT) sequencing, Polony sequencing, sequencing by ligation, reversible terminator sequencing, proton detection sequencing, ion semiconductor sequencing, nanopore sequencing, electronic sequencing, pyrosequencing, Maxam-Gilbert sequencing, chain termination (e.g., Sanger) sequencing, +S sequencing, or sequencing by synthesis. Sequencing methods also include next-generation sequencing, e.g., modern sequencing technologies such as Illumina sequencing (e.g., Solexa), Roche 454 sequencing, Ion torrent sequencing, and SOLiD sequencing. In some cases, next-generation sequencing involves high-throughput sequencing methods. Additional sequencing methods available to one of skill in the art may also be employed.

In some instances, a number of nucleotides that are sequenced are at least 5, 10, 15, 20, 25, 30, 35, 40, 45, 50, 100, 150, 200, 300, 400, 500, 2000, 4000, 6000, 8000, 10000, 20000, 50000, 100000, or more than 100000 nucleotides. In some instances, the number of nucleotides sequenced is in a range of about 1 to about 100000 nucleotides, about 1 to about 10000 nucleotides, about 1 to about 1000 nucleotides, about 1 to about 500 nucleotides, about 1 to about 300 nucleotides, about 1 to about 200 nucleotides, about 1 to about 100 nucleotides, about 5 to about 100000 nucleotides, about 5 to about 10000 nucleotides, about 5 to about 1000 nucleotides, about 5 to about 500 nucleotides, about 5 to about 300 nucleotides, about 5 to about 200 nucleotides, about 5 to about 100 nucleotides, about 10 to about 100000 nucleotides, about 10 to about 10000 nucleotides, about 10 to about 1000 nucleotides, about 10 to about 500 nucleotides, about 10 to about 300 nucleotides, about 10 to about 200 nucleotides, about 10 to about 100 nucleotides, about 20 to about 100000 nucleotides, about 20 to about 10000 nucleotides, about 20 to about 1000 nucleotides, about 20 to about 500 nucleotides, about 20 to about 300 nucleotides, about 20 to about 200 nucleotides, about 20 to about 100 nucleotides, about 30 to about 100000 nucleotides, about 30 to about 10000 nucleotides, about 30 to about 1000 nucleotides, about 30 to about 500 nucleotides, about 30 to about 300 nucleotides, about 30 to about 200 nucleotides, about 30 to about 100 nucleotides, about 50 to about 100000 nucleotides, about 50 to about 10000 nucleotides, about 50 to about 1000 nucleotides, about 50 to about 500 nucleotides, about 50 to about 300 nucleotides, about 50 to about 200 nucleotides, or about 50 to about 100 nucleotides.

In some cases, a method provided herein comprises determining the presence, absence, and/or quantity of a nucleic acid sequence from a particular genotype. In some embodiments, provided is a method of detecting a genotype comprising detecting the presence, absence, and/or quantity of a nucleic acid sequence, or portion thereof, selected from SEQ ID NOS: 5-8, or a combination thereof. In some cases, a portion of a nucleic acid sequence provided herein comprises at least about 10, 15, 20, 25, 30, 35, 40, 45, or 50 contiguous nucleobases. In some cases, a portion of a nucleic acid sequence provided herein comprises between about 10 and about 50 contiguous nucleobases, between about 10 and about 40 contiguous nucleobases, between about 15 and about 50 contiguous nucleobases, between about 15 and about 40 contiguous nucleobases, between about 20 and about 50 contiguous nucleobases, and between about 20 and about 40 contiguous nucleobases. In some cases, a portion of a nucleic acid sequence provided herein comprises about 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 contiguous nucleobases. In some cases, a portion of a nucleic acid sequence comprising SEQ ID NO: 5 comprises an "A" allele at the bracketed position. In some cases, a portion of a nucleic acid sequence comprising SEQ ID NO: 5 comprises a "G" allele at the bracketed position. In some cases, a portion of a nucleic acid sequence comprising SEQ ID NO: 6 comprises an "A" allele at the bracketed position. In some cases, a portion of a nucleic acid sequence comprising SEQ ID NO: 6 comprises a "G" allele at the bracketed position. In some cases, a portion of a nucleic acid sequence comprising SEQ ID NO: 7 comprises an "A" allele at the bracketed position. In some cases, a portion of a nucleic acid sequence comprising SEQ ID NO: 7 comprises a "G" allele at the bracketed position. In some cases, a portion of a nucleic acid sequence comprising SEQ ID NO: 8 comprises an "A" allele at the bracketed position. In some cases, a portion of a nucleic acid sequence comprising SEQ ID NO: 8 comprises a "G" allele at the bracketed position.

In some embodiments, the method comprises determining the presence or absence of a rs911605A genotype in a sample of genetic material from a subject, as determined by detecting the presence or absence of SEQ ID NO: 5, SEQ ID NO: 6, a portion of SEQ ID NO: 5, a portion of SEQ ID NO: 6, or a combination thereof, in the genetic material. In some cases, if the subject comprises the rs911605A genotype, the subject is administered an inhibitor of CD30L. In some cases, if the subject is homozygous for rs911605A, the subject is administered an inhibitor of CD30L.

In some embodiments, the method comprises determining the presence or absence of a rs911605A genotype in a sample of genetic material from a subject, as determined by detecting the presence or absence of a nucleic acid sequence at least or about 90% identical to SEQ ID NO: 5, a nucleic acid sequence at least or about 90% identical to SEQ ID NO: 6, a nucleic acid sequence at least or about 90% identical to a portion of SEQ ID NO: 5, a nucleic acid sequence at least or about 90% identical to a portion of SEQ ID NO: 6, or a combination thereof, in the genetic material. In some cases, if the subject comprises the rs911605A genotype, the subject is administered an inhibitor of CD30L. In some cases, if the subject is homozygous for rs911605A, the subject is administered an inhibitor of CD30L.

In some embodiments, the method comprises determining the presence or absence of a rs911605A genotype in a sample of genetic material from a subject, as determined by detecting the presence or absence of a nucleic acid sequence at least or about 95% identical to SEQ ID NO: 5, a nucleic acid sequence at least or about 95% identical to SEQ ID NO:

6, a nucleic acid sequence at least or about 95% identical to a portion of SEQ ID NO: 5, a nucleic acid sequence at least or about 95% identical to a portion of SEQ ID NO: 6, or a combination thereof, in the genetic material. In some cases, if the subject comprises the rs911605A genotype, the subject is administered an inhibitor of CD30L. In some cases, if the subject is homozygous for rs911605A, the subject is administered an inhibitor of CD30L.

In some embodiments, the method comprises determining the presence or absence of a rs1006026G genotype in a sample of genetic material from a subject, as determined by detecting the presence or absence of SEQ ID NO: 7, SEQ ID NO: 8, a portion of SEQ ID NO: 7, a portion of SEQ ID NO: 8, or a combination thereof, in the genetic material. In some cases, if the subject comprises the rs1006026G genotype, the subject is administered an inhibitor of CD30L. In some cases, if the subject is homozygous for rs1006026G, the subject is administered an inhibitor of CD30L.

In some embodiments, the method comprises determining the presence or absence of a rs1006026G genotype in a sample of genetic material from a subject, as determined by detecting the presence or absence of: a nucleic acid sequence at least or about 90% identical to SEQ ID NO: 7, a nucleic acid sequence at least or about 90% identical to SEQ ID NO: 8, a nucleic acid sequence at least or about 90% identical to a portion of SEQ ID NO: 7, a nucleic acid sequence at least or about 90% identical to a portion of SEQ ID NO: 8, or a combination thereof, in the genetic material. In some cases, if the subject comprises the rs1006026G genotype, the subject is administered an inhibitor of CD30L. In some cases, if the subject is homozygous for rs1006026G, the subject is administered an inhibitor of CD30L.

In some embodiments, the method comprises determining the presence or absence of a rs1006026G genotype in a sample of genetic material from a subject, as determined by detecting the presence or absence of a nucleic acid sequence at least or about 95% identical to SEQ ID NO: 7, a nucleic acid sequence at least or about 95% identical to SEQ ID NO: 8, a nucleic acid sequence at least or about 95% identical to a portion of SEQ ID NO: 7, a nucleic acid sequence at least or about 95% identical to a portion of SEQ ID NO: 8, or a combination thereof, in the genetic material. In some cases, if the subject comprises the rs1006026G genotype, the subject is administered an inhibitor of CD30L. In some cases, if the subject is homozygous for rs1006026G, the subject is administered an inhibitor of CD30L.

In some embodiments, the method comprises determining the presence or absence of a haplotype comprising rs911605A and rs1006026G in a sample of genetic material from a subject, as determined by detecting the presence or absence in the genetic material of: (a) SEQ ID NO: 5, SEQ ID NO: 6, a portion of SEQ ID NO: 5, a portion of SEQ ID NO: 6, or a combination thereof; and (b) SEQ ID NO: 7, SEQ ID NO: 8, a portion of SEQ ID NO: 7, a portion of SEQ ID NO: 8, or a combination thereof. In some cases, if the subject comprises rs911605A and rs1006026G, the subject is administered an inhibitor of CD30L. In some cases, if the subject is homozygous for rs911605A and homozygous for rs1006026G, the subject is administered an inhibitor of CD30L.

In some embodiments, the method comprises determining the presence or absence of a haplotype comprising rs911605A and rs1006026G in a sample of genetic material from a subject, as determined by detecting the presence or absence in the genetic material of: (a) a nucleic acid sequence at least or about 90% identical to SEQ ID NO: 5, a nucleic acid sequence at least or about 90% identical to SEQ ID NO: 6, a nucleic acid sequence at least or about 90% identical to a portion of SEQ ID NO: 5, a nucleic acid sequence at least or about 90% identical to a portion of SEQ ID NO: 6, or a combination thereof; and (b) a nucleic acid sequence at least or about 90% identical to SEQ ID NO: 7, a nucleic acid sequence at least or about 90% identical to SEQ ID NO: 8, a nucleic acid sequence at least or about 90% identical to a portion of SEQ ID NO: 7, a nucleic acid sequence at least or about 90% identical to a portion of SEQ ID NO: 8, or a combination thereof. In some cases, if the subject comprises rs911605A and rs1006026G, the subject is administered an inhibitor of CD30L. In some cases, if the subject is homozygous for rs911605A and homozygous for rs1006026G, the subject is administered an inhibitor of CD30L.

In some embodiments, the method comprises determining the presence or absence of a haplotype comprising rs911605A and rs1006026G in a sample of genetic material from a subject, as determined by detecting the presence or absence in the genetic material of: (a) a nucleic acid sequence at least or about 95% identical to SEQ ID NO: 5, a nucleic acid sequence at least or about 95% identical to SEQ ID NO: 6, a nucleic acid sequence at least or about 95% identical to a portion of SEQ ID NO: 5, a nucleic acid sequence at least or about 95% identical to a portion of SEQ ID NO: 6, or a combination thereof; and (b) a nucleic acid sequence at least or about 95% identical to SEQ ID NO: 7, a nucleic acid sequence at least or about 95% identical to SEQ ID NO: 8, a nucleic acid sequence at least or about 95% identical to a portion of SEQ ID NO: 7, a nucleic acid sequence at least or about 95% identical to a portion of SEQ ID NO: 8, or a combination thereof. In some cases, if the subject comprises rs911605A and rs1006026G, the subject is administered an inhibitor of CD30L. In some cases, if the subject is homozygous for rs911605A and homozygous for rs1006026G, the subject is administered an inhibitor of CD30L.

In some instances, a method of detecting a genotype comprises contacting nucleic acids from a sample of a subject with a nucleic acid polymer that hybridizes to a region of a target nucleic acid sequence. In some cases, the target nucleic acid sequence is a sequence comprising at least about 30, 40, 50, 60, 70, 80, 90, 100, or all of SEQ ID NO: 1, wherein the target nucleic acid sequence comprises the nucleobase at position 501. In some cases, the region of the target nucleic acid sequence comprises the nucleobase at position 501 of SEQ ID NO: 1. In some cases, the target nucleic acid sequence is a sequence comprising at least about 30, 40, 50, 60, 70, 80, 90, 100, or all of SEQ ID NO: 2, wherein the target nucleic acid sequence comprises the nucleobase at position 501. In some cases, the region of the target nucleic acid sequence comprises the nucleobase at position 501 of SEQ ID NO: 2. In some cases, the target nucleic acid sequence is a sequence comprising at least about 30, 40, 50, 60, 70, 80, 90, 100, or all of SEQ ID NO: 3, wherein the target nucleic acid sequence comprises the nucleobase at position 501. In some cases, the region of the target nucleic acid sequence comprises the nucleobase at position 501 of SEQ ID NO: 3. In some cases, the target nucleic acid sequence is a sequence comprising at least about 30, 40, 50, 60, 70, 80, 90, 100, or all of SEQ ID NO: 4, wherein the target nucleic acid sequence comprises the nucleobase at position 501. In some cases, the region of the target nucleic acid sequence comprises the nucleobase at position 501 of SEQ ID NO: 4. In some cases, the method is a multiplex assay where two or more target nucleic acid sequences are detected. As an example, the method comprises detecting the target nucleic acid sequence comprising the nucleobase at position 501 of SEQ ID NO: 1 and the target nucleic acid sequence comprising the nucleobase at position 501 of SEQ ID NO: 3. As another example, the method comprises detecting the target nucleic acid sequence comprising the nucleobase at position 501 of SEQ ID NO: 2 and the target nucleic acid sequence comprising the nucleobase at position 501 of SEQ ID NO: 4.

The nucleic acid polymer can comprise an oligonucleotide of at least or about 5, 10, 15, 20, 25, 30, 35, 40, 45, 50, 75, 100 or more nucleobases in length and sufficient to specifically hybridize to a target nucleic acid sequence as described herein. In some instances, the nucleic acid polymer comprises between about 10 and about 100 nucleobases, between about 10 and about 75 nucleobases, between about 10 and about 50 nucleobases, between about 15 and about 100 nucleobases, between about 15 and about 75 nucleobases, between about 15 and about 50 nucleobases, between about 20 and about 100 nucleobases, between about 20 and about 75 nucleobases, between about 20 and about 50 nucleobases, between about 25 and about 100 nucleobases, between about 25 and about 75 nucleobases, or between about 25 and about 50 nucleobases. In some instances, the nucleic acid polymer hybridizes to a region of a target nucleic acid sequence of least one of SEQ ID NOS: 1-8. In some instances, the nucleic acid polymer hybridizes to a target nucleic acid sequence comprising SEQ ID NO: 1. In some instances, the nucleic acid polymer hybridizes to a target nucleic acid sequence comprising SEQ ID NO: 2. In some instances, the nucleic acid polymer hybridizes to a target nucleic acid sequence comprising SEQ ID NO: 3 In some instances, the nucleic acid polymer hybridizes to a target nucleic acid sequence comprising SEQ ID NO: 4. In some instances, the nucleic acid polymer hybridizes to a target nucleic acid sequence comprising SEQ ID NO: 5. In some instances, the nucleic acid polymer hybridizes to a target nucleic acid sequence comprising SEQ ID NO: 6. In some instances, the nucleic acid polymer hybridizes to a target nucleic acid sequence comprising SEQ ID NO: 7. In some instances, the nucleic acid polymer hybridizes to a target nucleic acid sequence comprising SEQ ID NO: 8. Hybridization may occur at standard hybridization temperatures, e.g., between about 35° C. and about 65° C. in a standard PCR buffer.

Further provided are primers useful for amplifying a nucleic acid of a target nucleic acid described herein. For example, for use in an amplification assay such as qPCR. In some instances, the primers hybridize to at least a portion of one of SEQ ID NOS: 1-8. In some instances, provided is a forward primer that hybridizes to at least about 10 contiguous bases of SEQ ID NO: 1, and a reverse primer that hybridizes to at least 10 contiguous bases of SEQ ID NO: 1, such that the forward and reverse primer flank nucleobase position 501 in SEQ ID NO: 1. In some instances, provided is a forward primer that hybridizes to at least about 10 contiguous bases of SEQ ID NO: 2, and a reverse primer that hybridizes to at least 10 contiguous bases of SEQ ID NO: 2, such that the forward and reverse primer flank nucleobase position 501 in SEQ ID NO: 2. In some instances, provided is a forward primer that hybridizes to at least about 10 contiguous bases of SEQ ID NO: 3, and a reverse primer that hybridizes to at least 10 contiguous bases of SEQ ID NO: 3, such that the forward and reverse primer flank nucleobase position 501 in SEQ ID NO: 3. In some instances, provided is a forward primer that hybridizes to at least about 10 contiguous bases of SEQ ID NO: 4, and a reverse primer that hybridizes to at least 10 contiguous bases of SEQ ID NO: 4, such that the forward and reverse primer flank nucleobase position 501 in SEQ ID NO: 4.

In some cases, provided is a forward primer comprising SEQ ID NO 9. In some cases, provided is a forward primer comprising at least about 70%, 80%, 85%, 90%, 91%, 92%, 93%, 94%, 95%, 96%, 97%, 98% or 99% sequence identity to SEQ ID NO: 9. In some cases, provided is a reverse primer comprising SEQ ID NO 10. In some cases, provided is a reverse primer comprising at least about 70%, 80%, 85%, 90%, 91%, 92%, 93%, 94%, 95%, 96%, 97%, 98% or 99% sequence identity to SEQ ID NO: 10. In some cases, provided is a primer pair comprising a forward primer comprising SEQ ID NO: 9 and a reverse primer comprising SEQ ID NO: 10. In some cases, provided is a primer pair comprising a forward primer comprising at least about 70%, 80%, 85%, 90%, 91%, 92%, 93%, 94%, 95%, 96%, 97%, 98% or 99% sequence identity to SEQ ID NO: 9, and a reverse primer comprising at least about 70%, 80%, 85%, 90%, 91%, 92%, 93%, 94%, 95%, 96%, 97%, 98% or 99% sequence identity to SEQ ID NO: 10.

In some cases, provided is a forward primer comprising SEQ ID NO 11. In some cases, provided is a forward primer comprising at least about 70%, 80%, 85%, 90%, 91%, 92%, 93%, 94%, 95%, 96%, 97%, 98% or 99% sequence identity to SEQ ID NO: 11. In some cases, provided is a reverse primer comprising SEQ ID NO 12. In some cases, provided is a reverse primer comprising at least about 70%, 80%, 85%, 90%, 91%, 92%, 93%, 94%, 95%, 96%, 97%, 98% or 99% sequence identity to SEQ ID NO: 12. In some cases, provided is a primer pair comprising a forward primer comprising SEQ ID NO: 11 and a reverse primer comprising SEQ ID NO: 12. In some cases, provided is a primer pair comprising a forward primer comprising at least about 70%, 80%, 85%, 90%, 91%, 92%, 93%, 94%, 95%, 96%, 97%, 98% or 99% sequence identity to SEQ ID NO: 11, and a reverse primer comprising at least about 70%, 80%, 85%, 90%, 91%, 92%, 93%, 94%, 95%, 96%, 97%, 98% or 99% sequence identity to SEQ ID NO: 12.

Further provided are probe or reporter sequences that hybridize to a target nucleic acid described herein. As a non-limiting example, a target nucleic acid of rs911605 and/or rs1006026. In some cases the probes are reporters that comprise a dye label on one end and a quencher on the other end. When the probes are hybridized to a target nucleic acid, an added DNA polymerase may cleave those hybridized probes, separating the reporter dye from the quencher, and thus increasing fluorescence by the reporter. In some cases, provided is a probe comprising a nucleic acid polymer sequence described above herein. The probes may be used to detect and/or quantify the presence of a target nucleic acid in a given sample.

In some instances, provided is a probe comprising SEQ ID NO: 13. In some instances, provided is a probe comprises at least 70%, 80%, 85%, 90%, 91%, 92%, 93%, 94%, 95%, 96%, 97%, 98% or 99% sequence identity to SEQ ID NO: 13. In some instances, provided is a probe comprising SEQ ID NO: 14. In some instances, provided is a probe comprises at least 70%, 80%, 85%, 90%, 91%, 92%, 93%, 94%, 95%, 96%, 97%, 98% or 99% sequence identity to SEQ ID NO: 14. In some instances, provided is a probe comprising SEQ ID NO: 15. In some instances, provided is a probe comprises at least 70%, 80%, 85%, 90%, 91%, 92%, 93%, 94%, 95%, 96%, 97%, 98% or 99% sequence identity to SEQ ID NO: 15. In some instances, provided is a probe comprising SEQ ID NO: 16. In some instances, provided is a probe comprises at least 70%, 80%, 85%, 90%, 91%, 92%, 93%, 94%, 95%, 96%, 97%, 98% or 99% sequence identity to SEQ ID NO: 16.

Examples of molecules that are utilized as probes include, but are not limited to, RNA and DNA. In some embodiments, the term "probe" with regards to nucleic acids, refers to any molecule that is capable of selectively binding to a specifically intended target nucleic acid sequence. In some instances, probes are specifically designed to be labeled, for example, with a radioactive label, a fluorescent label, an enzyme, a chemiluminescent tag, a colorimetric tag, or other labels or tags that are known in the art. In some instances, the fluorescent label comprises a fluorophore. In some instances, the fluorophore is an aromatic or heteroaromatic compound. In some instances, the fluorophore is a pyrene, anthracene, naphthalene, acridine, stilbene, benzoxaazole, indole, benzindole, oxazole, thiazole, benzothiazole, canine, carbocyanine, salicylate, anthranilate, xanthenes dye, coumarin. Exemplary xanthene dyes include, e.g., fluorescein and rhodamine dyes. Fluorescein and rhodamine dyes include, but are not limited to 6-carboxyfluorescein (FAM), 2'7'-dimethoxy-4'5'-dichloro-6-carboxyfluorescein (JOE), tetrachlorofluorescein (TET), 6-carboxyrhodamine (R6G), N,N,N; N'-tetramethyl-6-carboxyrhodamine (TAMRA), 6-carboxy-X-rhodamine (ROX). Suitable fluorescent probes also include the naphthylamine dyes that have an amino group in the alpha or beta position. For example, naphthylamino compounds include 1-dimethylaminonaphthyl-5-sulfonate, 1-anilino-8-naphthalene sulfonate and 2-p-toluidinyl-6-naphthalene sulfonate, 5-(2'-aminoethyl) aminonaphthalene-1-sulfonic acid (EDANS). Exemplary coumarins include, e.g., 3-phenyl-7-isocyanatocoumarin; acridines, such as 9-isothiocyanatoacridine and acridine orange; N-(p-(2-benzoxazolyl)phenyl) maleimide; cyanines, such as, e.g., indodicarbocyanine 3 (Cy3), indodicarbocyanine 5 (Cy5), indodicarbocyanine 5.5 (Cy5.5), 3-(1-carboxy-pentyl)-3'-ethyl-5,5'-dimethyloxacarbocyanine (CyA); 1H, 5H, 11H, 15H-Xantheno[2,3,4-ij: 5,6,7-i'j']diquinolizin-18-ium, 9-[2 (or 4)-[[[6-[2,5-dioxo-1-pyrrolidinyl)oxy]-6-oxohexyl]amino]sulfonyl]-4 (or 2)-sulfophenyl]-2,3,6,7,12,13,16,17-octahydro-inner salt (TR or Texas Red); or BODIPY™ dyes. In some cases, the probe comprises FAM as the dye label.

In some instances, primers and/or probes described herein for detecting a target nucleic acid are used in an amplification reaction. In some instances, the amplification reaction is qPCR. An exemplary qPCR is a method employing a TaqMan™ assay.

In some instances, qPCR comprises using an intercalating dye. Examples of intercalating dyes include SYBR green I, SYBR green II, SYBR gold, ethidium bromide, methylene blue, Pyronin Y, DAPI, acridine orange, Blue View or phycoerythrin. In some instances, the intercalating dye is SYBR.

In some instances, a number of amplification cycles for detecting a target nucleic acid in an amplification assay is about 5 to about 30 cycles. In some instances, the number of amplification cycles for detecting a target nucleic acid is at least about 5 cycles. In some instances, the number of amplification cycles for detecting a target nucleic acid is at most about 30 cycles. In some instances, the number of amplification cycles for detecting a target nucleic acid is about 5 to about 10, about 5 to about 15, about 5 to about 20, about 5 to about 25, about 5 to about 30, about 10 to about 15, about 10 to about 20, about 10 to about 25, about 10 to about 30, about 15 to about 20, about 15 to about 25, about 15 to about 30, about 20 to about 25, about 20 to about 30, or about 25 to about 30 cycles.

In one aspect, the methods provided herein for determining the presence, absence, and/or quantity of a nucleic acid sequence from a particular genotype comprise an amplification reaction such as qPCR. In an exemplary method, genetic material is obtained from a sample of a subject, e.g., a sample of blood or serum. In certain embodiments where nucleic acids are extracted, the nucleic acids are extracted using any technique that does not interfere with subsequent analysis. In certain embodiments, this technique uses alcohol precipitation using ethanol, methanol or isopropyl alcohol. In certain embodiments, this technique uses phenol, chloroform, or any combination thereof. In certain embodiments, this technique uses cesium chloride. In certain embodiments, this technique uses sodium, potassium or ammonium acetate or any other salt commonly used to precipitate DNA. In certain embodiments, this technique utilizes a column or resin based nucleic acid purification scheme such as those commonly sold commercially, one non-limiting example would be the GenElute Bacterial Genomic DNA Kit available from Sigma Aldrich. In certain embodiments, after extraction the nucleic acid is stored in water, Tris buffer, or Tris-EDTA buffer before subsequent analysis. In an exemplary embodiment, the nucleic acid material is extracted in water. In some cases, extraction does not comprise nucleic acid purification.

In the exemplary qPCR assay, the nucleic acid sample is combined with primers and probes specific for a target nucleic acid that may or may not be present in the sample, and a DNA polymerase. An amplification reaction is performed with a thermal cycler that heats and cools the sample for nucleic acid amplification, and illuminates the sample at a specific wavelength to excite a fluorophore on the probe and detect the emitted fluorescence. For TaqMan™ methods, the probe may be a hydrolysable probe comprising a fluorophore and quencher that is hydrolyzed by DNA polymerase when hybridized to a target nucleic acid. In some cases, the presence of a target nucleic acid is determined when the number of amplification cycles to reach a threshold value is less than 30, 29, 28, 27, 26, 25, 24, 23, 22, 21, or 20 cycles. In some cases, a target nucleic acid comprises SEQ ID NO: 5, and the presence of the target nucleic acid is indicative of a rs911605A genotype. In some cases, a target nucleic acid comprises SEQ ID NO: 6, and the presence of the target nucleic acid is indicative of a rs911605A genotype. In some cases, a target nucleic acid comprises SEQ ID NO: 7, and the presence of the target nucleic acid is indicative of a rs1006026G genotype. In some cases, a target nucleic acid comprises SEQ ID NO: 8, and the presence of the target nucleic acid is indicative of a rs1006026G genotype. The primers and probes in the assay may include any combination of the primers and probes described herein. As such, a multiplex assay may be performed where a haplotype comprising rs911605A and rs1006026G is detectable in the assay.

Methods of Detecting and Quantifying Soluble CD30

Aspects provided herein are methods of analyzing CD30 protein levels in a subject by detecting and quantifying said levels from a sample of the subject. Non-limiting examples of sample materials include serum, plasma, and/or whole blood. CD30 may be detected by use of an antibody-based assay, where an anti-CD30 antibody is utilized. For antibody-based detection methods, the anti-CD30 antibody may bind to any region of CD30. In some cases, the anti-CD30 antibody binds to a region of a CD30 protein having SEQ ID NO: 17, or SEQ ID NO: 18, or a sequence of any CD30 protein-coding isoform (for e.g., P28908). In some cases, the anti-CD30 antibody binds to a region of a CD30 protein having a sequence at least or about 70%, 80%, 85%, 90%, 91%, 92%, 93%, 94%, 95%, 96%, 97%, 98%, 99%, or 100% sequence identity SEQ ID NO: 17. An exemplary method of analysis comprises performing an enzyme-linked immunosorbent assay (ELISA). The ELISA assay may be a sandwich ELISA or a direct ELISA. Other exemplary methods of detection includes immunohistochemistry and lateral flow assay.

In some cases, CD30 protein may be detected by detecting binding between CD30 and CD30L. Methods of analysis of binding between CD30 and CD30L comprise performing an assay in vivo or in vitro, or ex vivo. In some instances, the assay may comprise co-immunoprecipitation (co-IP), pull-down, crosslinking protein interaction analysis, labeled transfer protein interaction analysis, or Far-western blot analysis, FRET based assay, including, for example FRET-FLIM, a yeast two-hybrid assay, BiFC, or split luciferase assay.

Methods of Characterizing a Disease or Condition or Subtype Thereof

Disclosed herein are methods of characterizing a disease or a condition, or a subtype or symptom of the disease or the condition in a subject. In some cases, the disease or condition is at least on of an inflammatory disease, fibrostenotic disease, and fibrotic disease. In some instances, the inflammatory diseases is Crohn's disease (CD). In some instances, the inflammatory disease is ulcerative colitis (UC). In some instances, the inflammatory disease is systemic lupus erythematosus (SLE). In some instances, the inflammatory disease is rheumatoid arthritis (RA). In some instances, the fibrotic disease is primary sclerosing cholangitis (PSC). The subject may be diagnosed with the disease or the condition, and embodiments disclosed herein provide methods of characterizing the disease or condition as being a severe form of the disease or the condition (e.g., refractory disease). In some instances, the severe form of the disease is characterized by a presence of, or susceptibility to developing, a subclinical phenotype of the disease or the condition, such as for example, perianal disease (e.g., pCD), stricturing disease, penetrating disease, stricturing and penetrating disease, ileal disease, and ileocolonic disease.

Aspects disclosed herein provide methods of characterizing a disease or a condition, or a subtype of the disease or the condition comprising: (a) subjecting a sample obtained from a subject to an assay configured to detect a presence, absence, or a level of a genotype; and (b) characterizing the disease as being a severe form of the disease or the condition, provided the presence or the level of the genotype is detected in the sample obtained from the subject. In some instances, genotype comprises at least one polymorphism selected from Tables 1-14. In some cases, the genotype comprises a rs911605A genotype (e.g., comprise an "A" allele at position 501 of rs911605). In some instances, the genotype is a haplotype comprising a rs911605A genotype (e.g., comprise an "A" allele at position 501 of rs911605) and a rs1006026G genotype (e.g., comprise a "G" allele at position 501 of rs1006026) is detected in a sample obtained from the subject. In some instances, the genotype comprises a rs1006026G genotype (e.g., comprise a "G" allele at position 501 of rs1006026). In some instances, the subtype of the disease or the condition comprises a subclinical phenotype selected from the group consisting of non-stricturing disease, stricturing disease, stricturing and penetrating disease, perianal Crohn's disease (pCD), defects in Paneth cells, PSC, and development of blood clots (e.g. thrombus). In some instances, a therapeutic agent is administered to the subject, provided the presence of the genotype is detected in the sample obtained from the subject. In some instances, the therapeutic agent is an inhibitor of CD30 ligand, TL1A, or a combination thereof. In some instances, the genotype is detected in the sample obtained from the subject using the methods described herein, such as for e.g., a genotyping device (e.g., qPCR, sequencer, microarray, and the like).

Methods of Diagnosis and Prognosis

Disclosed herein are methods of diagnosing or determining a susceptibility to developing (e.g., delivering a prognosis of) a disease or a condition, or a subtype or symptom of the disease or the condition in a subject. In some cases, the disease or condition is at least on of an inflammatory disease, fibrostenotic disease, and fibrotic disease. In some instances, the inflammatory diseases is Crohn's disease (CD). In some instances, the inflammatory disease is ulcerative colitis (UC). In some instances, the inflammatory disease is systemic lupus erythematosus (SLE). In some instances, the inflammatory disease is rheumatoid arthritis (RA). In some instances, the fibrotic disease is primary sclerosing cholangitis (PSC). The subject may be diagnosed with the disease or the condition, and embodiments disclosed herein provide methods of characterizing the disease or condition as being a severe form of the disease or the condition (e.g., refractory disease). In some instances, the severe form of the disease is characterized by a presence of, or susceptibility to developing, a subclinical phenotype of the disease or the condition, such as for example, perianal disease (e.g., pCD), stricturing disease, penetrating disease, stricturing and penetrating disease, ileal disease, and ileocolonic disease.

Aspects disclosed herein provide methods of diagnosing in a subject a disease or a condition a disease or a condition, or a subtype of the disease or the condition comprising: (a) subjecting a sample obtained from a subject to an assay configured to detect a presence, absence, or a level of a genotype; and (b) diagnosis the disease as being a severe form of the disease or the condition, provided the presence or the level of the genotype is detected in the sample obtained from the subject.

Also provided herein are methods of determining a susceptibility to developing a disease or a condition a disease or a condition, or a subtype of the disease or the condition, in a subject, the methods comprising: (a) subjecting a sample obtained from a subject to an assay configured to detect a presence, absence, or a level of a genotype; and (b) determining a risk of developing the disease or the condition, or the subtype of the disease or the condition, in the subject, provided the presence or the level of the genotype is detected in the sample obtained from the subject.

In some instances, genotype comprises at least one polymorphism selected from Tables 1-14. In some cases, the genotype comprises a rs911605A genotype (e.g., comprise an "A" allele at position 501 of rs911605). In some instances, the genotype is a haplotype comprising a rs911605A genotype (e.g., comprise an "A" allele at position 501 of rs911605) and a rs006026G genotype (e.g., comprise a "G" allele at position 501 of rs1006026) is detected in a sample obtained from the subject. In some instances, the genotype comprises a rs1006026G genotype (e.g., comprise a "G" allele at position 501 of rs1006026). In some instances, the subtype of the disease or the condition comprises a subclinical phenotype selected from the group consisting of non-stricturing disease, stricturing disease, stricturing and penetrating disease, perianal Crohn's disease (pCD), defects in Paneth cells, PSC, and development of blood clots (e.g. thrombus). In some instances, a presence of the genotype is indicative of an increased level of CD30 ligand in the subject, as compared to an individual who does not carry the genotype. In some instances, a therapeutic agent is administered to the subject, provided the presence of the genotype is detected in the sample obtained from the subject. In some instances, the therapeutic agent is an inhibitor of CD30 ligand, TL1A, or a combination thereof. In some instances, the genotype is detected in the sample obtained from the subject using the methods described herein, such as for e.g., a genotyping device (e.g., qPCR, sequencer, microarray, and the like).

Methods of Treatment

Further provided herein are methods of treating a disease or condition in a subject. In some cases, the disease or condition is at least on of an inflammatory disease, fibrostenotic disease, and fibrotic disease. In some instances, the inflammatory diseases is Crohn's disease (CD). In some instances, the inflammatory disease is ulcerative colitis (UC). In some instances, the inflammatory disease is systemic lupus erythematosus (SLE). In some instances, the inflammatory disease is rheumatoid arthritis (RA). In some instances, the fibrotic disease is primary sclerosing cholangitis (PSC).

Disclosed herein are methods of treating a disease or condition disclosed herein in a subject by administrating to the subject an inhibitor of CD30L, provided a genotype disclosed herein is detected in a sample obtained from the subject. The genotype can be any one of the genotypes described in the embodiments provided in the present disclosure, including but not limited to any one or, or combination of, polymorphisms from Tables 1-14. In some cases, the genotype comprises a rs911605A genotype (e.g., comprise an "A" allele at position 501 of rs911605). In some instances, disclosed herein are methods of treating a subject suffering from a disease or condition disclosed herein by administering to the subject an inhibitor of CD30L, provided that a haplotype comprising a rs911605A genotype (e.g., comprise an "A" allele at position 501 of rs911605) and a rs1006026G genotype (e.g., comprise a "G" allele at position 501 of rs1006026) is detected in a sample obtained from the subject. In some cases, the genotype is detected in the sample obtained from the subject using methods of detection disclosed herein.

Aspects disclosed herein provide methods of monitoring a progression of treatment of a subject with an inhibitor of CD30L. In some instances, monitoring comprises quantifying soluble CD30 or CD30L levels in a sample from the subject prior to and after administration of the inhibitor of CD30L. Also disclosed herein are methods of optimizing the treatment of a subject comprising: determining the quantity of CD30 and/or CD30L in a sample from a treated subject and modifying, discontinuing, or continuing the treatment based on the quantity.

Inhibitors of CD30L

In some instances, the treatment comprises administering to the individual a therapeutic agent comprising an inhibitor of CD30L. In some embodiments, an inhibitor of CD30L specifically binds directly or indirectly to CD30L, CD30, or a molecule that interferes directly or indirectly with binding between CD30L and CD30. In some embodiments, as used herein, an inhibitor of CD30L comprises an agent that modulates at least one functional activity of CD30L, such as binding to CD30. Non-limiting examples of inhibitors of CD30L include agents that specifically bind to CD30L, including a polypeptide such as an anti-CD30L antibody or antigen binding fragment thereof, and a nucleic acid, e.g., an antisense construct, siRNA, and ribozyme. An antisense construct includes an expression plasmid that when transcribed in the cell produces RNA complementary to a portion of mRNA encoding CD30L, and an oligonucleotide that inhibits protein expression by hybridizing with the CD30L mRNA. In some embodiments the inhibitor of CD30L comprises a non-polypeptide or non-nucleic acid portion as an active agent that binds to and inhibits CD30L activity.

In some embodiments, an inhibitor of CD30L is a polypeptide that binds to CD30L and/or CD30. In some cases, the polypeptide is a CD30 polypeptide or a portion thereof, wherein the portion retains the ability to bind to CD30L. A portion of a CD30 polypeptide includes at least about 10, 15, 20, 25, 30, 35, 40, 45, or 50 amino acids that have at least about 85%, 90%, or 95% identity to human CD30 having SEQ ID NO: 17 or SEQ ID NON: 18. For example, an inhibitor of CD30L comprises a CD30 polypeptide that comprises all or part of the extracellular region of human CD30. In some embodiments, the CD30 polypeptide comprises amino acids 19-390 of SEQ ID NO: 18 or a binding fragment thereof, having at least about 85%, 90%, or 95% sequence identity to CD30. In some embodiments, the CD30 polypeptide is a homologue of mammalian CD30, e.g., the CD30 polypeptide inhibitor of CD30L is a viral CD30 polypeptide or fragment thereof. As a non-limiting example, the viral CD30 polypeptide comprises viral CD30 from a poxvirus, such as ectromelia virus or cowpox virus.

In a non-limiting example, the inhibitor is an anti-CD30L antibody or an anti-CD30 antibody. As used herein, an antibody includes an antigen-binding fragment of a full length antibody, e.g., a Fab or scFv. In some embodiments, the antibody binds to the extracellular domain of CD30L. In some embodiments, an anti-CD30L antibody comprises a heavy chain comprising three complementarity-determining regions: HCDR1, HCDR2, and HCDR3; and a light chain comprising three complementarity-determining regions: LCDR1, LCDR2, and LCDR3. In some embodiments, the anti-CD30L antibody comprises a HCDR1 comprising SEQ ID NO: 100, a HCDR2 comprising SEQ ID NO: 101, a HCDR3 comprising SEQ ID NO: 102, a LCDR1 comprising SEQ ID NO: 103, a LCDR2 comprising SEQ ID NO: 104, and a LCDR3 comprising SEQ ID NO: 105.

In some embodiments, the anti-CD30L antibody comprises a HCDR1 comprising SEQ ID NO: 106, a HCDR2 comprising SEQ ID NO: 107, a HCDR3 comprising SEQ ID NO: 108, a LCDR1 comprising SEQ ID NO: 109, a LCDR2 comprising SEQ ID NO: 110, and a LCDR3 comprising SEQ ID NO: 111.

In some embodiments, the anti-CD30L antibody comprises a HCDR1 comprising SEQ ID NO: 112, a HCDR2 comprising SEQ ID NO: 113, a HCDR3 comprising SEQ ID NO: 114, a LCDR1 comprising SEQ ID NO: 115, a LCDR2 comprising SEQ ID NO: 116, and a LCDR3 comprising SEQ ID NO: 117.

In some embodiments, the anti-CD30L antibody comprises a HCDR1 comprising SEQ ID NO: 118, a HCDR2 comprising SEQ ID NO: 119, a HCDR3 comprising SEQ ID NO: 120, a LCDR1 comprising SEQ ID NO: 121, a LCDR2 comprising SEQ ID NO: 122, and a LCDR3 comprising SEQ ID NO: 123.

In some embodiments, the anti-CD30L antibody comprises a HCDR1 comprising SEQ ID NO: 124, a HCDR2 comprising SEQ ID NO: 125, a HCDR3 comprising SEQ ID NO: 126, a LCDR1 comprising SEQ ID NO: 127, a LCDR2 comprising SEQ ID NO: 128, and a LCDR3 comprising SEQ ID NO: 129.

In some embodiments, the anti-CD30L antibody comprises a HCDR1 comprising SEQ ID NO: 130, a HCDR2 comprising SEQ ID NO: 131, a HCDR3 comprising SEQ ID NO: 132, a LCDR1 comprising SEQ ID NO: 133, a LCDR2 comprising SEQ ID NO: 134, and a LCDR3 comprising SEQ ID NO: 135.

In some cases, the anti-CD30L antibody comprises a heavy chain (HC) variable domain comprising SEQ ID NO: 136 and a light chain (LC) variable domain comprising SEQ ID NO: 137. In some cases, the anti-CD30L antibody comprises a heavy chain (HC) variable domain comprising SEQ ID NO: 138 and a light chain (LC) variable domain comprising SEQ ID NO: 139. In some cases, the anti-CD30L antibody comprises a heavy chain (HC) variable domain comprising SEQ ID NO: 140 and a light chain (LC) variable domain comprising SEQ ID NO: 141. In some cases, the anti-CD30L antibody comprises a heavy chain (HC) variable domain comprising SEQ ID NO: 142 and a light chain (LC) variable domain comprising SEQ ID NO: 143. In some cases, the anti-CD30L antibody comprises a heavy chain (HC) variable domain comprising SEQ ID NO: 144 and a light chain (LC) variable domain comprising SEQ ID NO: 145. In some cases, the anti-CD30L antibody comprises a heavy chain (HC) variable domain comprising SEQ ID NO: 146 and a light chain (LC) variable domain comprising SEQ ID NO: 154. In some cases, the anti-CD30L antibody comprises a heavy chain (HC) variable domain comprising SEQ ID NO: 147 and a light chain (LC) variable domain comprising SEQ ID NO: 154. In some cases, the anti-CD30L antibody comprises a heavy chain (HC) variable domain comprising SEQ ID NO: 148 and a light chain (LC) variable domain comprising SEQ ID NO: 154. In some cases, the anti-CD30L antibody comprises a heavy chain (HC) variable domain comprising SEQ ID NO: 149 and a light chain (LC) variable domain comprising SEQ ID NO: 154. In some cases, the anti-CD30L antibody comprises a heavy chain (HC) variable domain comprising SEQ ID NO: 150 and a light chain (LC) variable domain comprising SEQ ID NO: 154. In some cases, the anti-CD30L antibody comprises a heavy chain (HC) variable domain comprising SEQ ID NO: 151 and a light chain (LC) variable domain comprising SEQ ID NO: 154. In some cases, the anti-CD30L antibody comprises a heavy chain (HC) variable domain comprising SEQ ID NO: 152 and a light chain (LC) variable domain comprising SEQ ID NO: 154. In some cases, the anti-CD30L antibody comprises a heavy chain (HC) variable domain comprising SEQ ID NO: 153 and a light chain (LC) variable domain comprising SEQ ID NO: 154.

In some embodiments, the anti-CD30 antibody comprises a heavy chain variable region comprising SEQ ID NO: 19 and a light chain variable region comprising SEQ ID NO: 20. Non-limiting examples of anti-CD30 antibodies include MDX-60, Ber-H2, SGN-30 (cAC10), Ki-4.dgA, HRS-3/A9, AFM13, and H22xKi-4.

In some embodiments, the CD30L conjugate comprises an anti-CD30L antibody comprising at least one amino acid and a conjugating moiety bound to the at least one 1 amino acid. In some embodiments, the at least one amino acid is located proximal to the N-terminus (e.g., proximal to the N-terminal residue). For example, the at least one amino acid is located optionally within the first 10, 20, 30, 40, or 50 residues from the N-terminus. In some cases, the at least one amino acid is located at the N-terminus (i.e., the at least one amino acid is the N-terminal residue of the CD30L polypeptide). In other embodiments, the at least one amino acid is located proximal to the C-terminus (e.g., proximal to the C-terminal residue). For example, the at least one amino acid is located optionally within the first 10, 20, 30, 40, or 50 residues from the C-terminus. In some cases, the at least one amino acid is located at the C-terminus (i.e., the at least one amino acid is the C-terminal residue of the CD30L polypeptide). In some instances, the CD30L conjugate has an enhanced plasma half-life, such as the half-lives described herein. In some embodiments, the CD30L conjugate is functionally active (e.g., retains activity). In some embodiments, the CD30L conjugate is not functionally active (e.g., devoid of activity). In some embodiments, the conjugating moiety comprises a polymer comprising Polyethylene glycol (PEG). In some embodiments, the conjugating moiety is a drug, such as an additional therapeutic agent disclosed herein. In some embodiments, the anti-CD30 antibody comprises an antibody drug conjugate. As a non-limiting example, the antibody drug conjugate is brentuximab, an anti-CD30 antibody conjugated to monomethyl auristatin E.

Additional Therapeutic Agents

Treatments useful with the methods described herein include therapeutic agents that may be used alone, or in combination with an inhibitor of CD30L. In some embodiments, treatment comprises administering a first therapeutic agent and then an inhibitor of CD30L. In some embodiments, treatment comprises administering a first therapeutic agent and an inhibitor of CD30L together. In some embodiments, treatment comprises administering an inhibitor of CD30L and then a first therapeutic agent. The combination therapies may be administered within the same day, or may be administered one or more days, weeks, months, or years apart. In some cases, an inhibitor of CD30L is administered if the subject is determined to be non-responsive to a first line of therapy, e.g., such as TNF inhibitor and/or steroid. Such determination may be made by treatment with the first line therapy and monitoring of disease state and/or diagnostic determination that the subject would be non-responsive to the first line therapy.

In some embodiments, the therapeutic agent comprises an anti-TNF therapy, e.g., an anti-TNFa therapy. In some embodiments, the therapeutic agent comprises a second-line treatment to an anti-TNF therapy. In some embodiments, the therapeutic agent comprises an immunosuppressant, or a class of drugs that suppress, or reduce, the strength of the immune system. In some embodiments, the immunosuppressant is an antibody. Non-limiting examples of immunosuppressant therapeutic agents include STELARA® (ustekinumab) azathioprine (AZA), 6-mercaptopurine (6-MP), methotrexate, cyclosporin A. (CsA).

In some embodiments, the therapeutic agent comprises a selective anti-inflammatory drug, or a class of drugs that specifically target pro-inflammatory molecules in the body. In some embodiments, the anti-inflammatory drug comprises an antibody. In some embodiments, the anti-inflammatory drug comprises a small molecule. Non-limiting examples of anti-inflammatory drugs include ENTYVIO (vedolizumab), corticosteroids, aminosalicylates, mesalamine, balsalazide (Colazal) and olsalazine (Dipentum).

In some embodiments, the therapeutic agent comprises a stem cell therapy. The stem cell therapy may be embryonic or somatic stem cells. The stem cells may be isolated from a donor (allogeneic) or isolated from the subject (autologous). The stem cells may be expanded adipose-derived stem cells (eASCs), hematopoietic stem cells (HSCs), mesenchymal stem (stromal) cells (MSCs), or induced pluripotent stem cells (iPSCs) derived from the cells of the subject. In some embodiments, the therapeutic agent comprises Cx601/Alofisel® (darvadstrocel).

In some embodiments, the therapeutic agent comprises a small molecule. The small molecule may be used to treat inflammatory diseases or conditions, or fibrostenotic or fibrotic disease. Non-limiting examples of small molecules include Otezla® (apremilast), alicaforsen, or ozanimod (RPC-1063).

In some embodiments, the therapeutic agent comprises an agonist of Mitogen-Activated Protein Kinase Kinase Kinase Kinase 4 (MAP4K4), Prostaglandin E Receptor 4 (PTGER4), interleukin 18 receptor 1 (IL18R1). 6-Phosphofructo-2-Kinase/Fructose-2,6-Biphosphatase 3 (PFKFB3), Interleukin 18 Receptor Accessory Protein (IL18RAP), Adenylate Cyclase 7 (ADCY7), B Lymphoid Tyrosine Kinase (BLK), G Protein-Coupled Receptor 65 (GPR65), Sprouty Related EVH1 Domain Containing 2 (SPRED2), Src Kinase Associated Phosphoprotein 2 (SKAP2), Receptor Interacting Serine/Threonine Kinase 2 (RIPK2), and TNF Ligand Superfamily Member 15 (TLTA), Janus Kinase 1 (JAK1) G-protein Coupled Receptor 35 (GPR35), Gasdermin B (GSDMB), and gene expression products from genes implicated in the pathogenesis of inflammatory, fibrotic, or fibrostenotic disease. The therapeutic agent may be an allosteric modulator of MAP4K4, PTGER4, IL18R1, PFKFB3, IL18RAP, ADCY7, GPR65, SPRED2, SKAP2, RIPK2, TL1A, JAK1, GPR35, and GSDMB, and gene expression products from genes implicated in the pathogenesis of inflammatory, fibrotic, or fibrostenotic disease.

In some embodiments, the therapeutic agent comprises an antagonist. The antagonist may comprise an inhibitor of the activity or expression of MAP4K4, PTGER4, IL18R1, PFKFB3, IL18RAP, ADCY7, GPR65, SPRED2, SKAP2, RIPK2, TL1A, JAK1, GPR35, and GSDMB, and gene expression products from genes implicated in the pathogenesis of inflammatory, fibrotic, or fibrostenotic disease. Non-limiting examples of JAK1 inhibitors include Ruxolitinib (INCB018424), S-Ruxolitinib (INCB018424), Baricitinib (LY3009104, INCB028050), Filgotinib (GLPG0634), Momelotinib (CYT387), Cerdulatinib (PRT062070, PRT2070), LY2784544, NVP-BSK805, 2HCl, Tofacitinib (CP-690550, Tasocitinib), XL019, Pacritinib (SB1518), or ZM 39923 HCl.

In some embodiments the additional therapeutic agent comprises an inhibitor of TL1A expression or activity. In some cases, the inhibitor of TL1A expression or activity is effective to inhibit TL1A-DR3 binding. In some embodiments, the inhibitor of TL1A expression or activity comprises an allosteric modulator of TL1A. An allosteric modulator of TL1A may indirectly influence the effects TL1A on DR3, or TR6/DcR3 on TL1A or DR3. The inhibitor of TLA expression or activity may be a direct inhibitor or indirect inhibitor. Non-limiting examples of an inhibitor of TL1A expression include RNA to protein TL1A translation inhibitors, antisense oligonucleotides targeting the TNFSF15 mRNA (such as miRNAs, or siRNA), epigenetic editing (such as targeting the DNA-binding domain of TNFSF15, or post-translational modifications of histone tails and/or DNA molecules). Non-limiting examples of an inhibitor of TL1A activity include antagonists to the TL1A receptors, (DR3 and TR6/DcR3), antagonists to TL1A antigen, and antagonists to gene expression products involved in TL1A mediated disease. Antagonists as disclosed herein, may include, but are not limited to, an anti-TL1A antibody, an anti-TL1A-binding antibody fragment, or a small molecule. The small molecule may be a small molecule that binds to TL1A or DR3. The anti-TL1A antibody may be monoclonal or polyclonal. The anti-TL1A antibody may be humanized or chimeric. The anti-TL1A antibody may be a fusion protein. The anti-TL1A antibody may be a blocking anti-TL1A antibody. A blocking antibody blocks binding between two proteins, e.g., a ligand and its receptor. Therefore, a TL1A blocking antibody includes an antibody that prevents binding of TL1A to DR3 or TR6/DcR3 receptors. In a non-limiting example, the TL1A blocking antibody binds to DR3. In another example, the TL1A blocking antibody binds to DcR3. In some cases, the TL1A antibody is an anti-TL1A antibody that specifically binds to TL1A.

The anti-TL1A antibody may comprise one or more of the antibody sequences of Table 16 and/or Table 17. The anti-DR3 antibody may comprise an amino acid sequence that is at least 85% identical to any one of SEQ ID NOS: 200258-200270 and an amino acid sequence that is at least 85% identical to any one of SEQ ID NOS: 200271-200275. The anti-DR3 antibody may comprise an amino acid sequence comprising the HCDR1, HCDR2, HCDR3 domains of any one of SEQ ID NOS: 200258-200270 and the LCDR1, LCDR2, and LCDR3 domains of any one of SEQ ID NOS: 200271-200275.

In some embodiments, an anti-TL1A antibody comprises a heavy chain comprising three complementarity-determining regions: HCDR1, HCDR2, and HCDR3; and a light chain comprising three complementarity-determining regions: LCDR1, LCDR2, and LCDR3. In some embodiments, the anti-TL1A antibody comprises a HCDR1 comprising SEQ ID NO: 200109, a HCDR2 comprising SEQ ID NO: 200110, a HCDR3 comprising SEQ ID NO: 200111, a LCDR1 comprising SEQ ID NO: 200112, a LCDR2 comprising SEQ ID NO: 200113, and a LCDR3 comprising SEQ ID NO: 200114. In some cases, the anti-TL1A antibody comprises a heavy chain (HC) variable domain comprising SEQ ID NO: 200115 and a light chain (LC) variable domain comprising SEQ ID NO: 200116.

In some embodiments, the anti-TL1A antibody comprises a HCDR1 comprising SEQ ID NO: 200117, a HCDR2 comprising SEQ ID NO: 200118, a HCDR3 comprising SEQ ID NO: 200119, a LCDR1 comprising SEQ ID NO: 200120, a LCDR2 comprising SEQ ID NO: 200121, and a LCDR3 comprising SEQ ID NO: 200122. In some cases, the anti-TL1A antibody comprises a heavy chain (HC) variable domain comprising SEQ ID NO: 200123 and a light chain (LC) variable domain comprising SEQ ID NO: 200124.

In some embodiments, the anti-TL1A antibody comprises a HCDR1 comprising SEQ ID NO: 200125, a HCDR2 comprising SEQ ID NO: 200126, a HCDR3 comprising SEQ ID NO: 200127, a LCDR1 comprising SEQ ID NO: 200128, a LCDR2 comprising SEQ ID NO: 200129, and a LCDR3 comprising SEQ ID NO: 200130. In some cases, the anti-TL1A antibody comprises a heavy chain (HC) variable domain comprising SEQ ID NO: 200131 and a light chain (LC) variable domain comprising SEQ ID NO: 200132.

In some embodiments, the anti-TL1A antibody comprises a HCDR1 comprising SEQ ID NO: 200133, a HCDR2 comprising SEQ ID NO: 200134, a HCDR3 comprising SEQ ID NO: 200135, a LCDR1 comprising SEQ ID NO: 200139, a LCDR2 comprising SEQ ID NO: 200140, and a LCDR3 comprising SEQ ID NO: 200141. In some cases, the anti-TL1A antibody comprises a HCDR1 comprising SEQ ID NO: 2000136, a HCDR2 comprising SEQ ID NO: 200137, a HCDR3 comprising SEQ ID NO: 200138, a LCDR1 comprising SEQ ID NO: 200139, a LCDR2 comprising SEQ ID NO: 200140, and a LCDR3 comprising SEQ ID NO: 200141. In some cases, the anti-TL1A antibody comprises a heavy chain (HC) variable domain comprising SEQ ID NO: 200142 and a light chain (LC) variable domain comprising SEQ ID NO: 200143. In some cases, the anti-TL1A antibody comprises a heavy chain comprising SEQ ID NO: 200144. In some cases, the anti-TL1A antibody comprises a light chain comprising SEQ ID NO: 200145.

In some embodiments, the anti-TL1A antibody comprises a HCDR1 comprising SEQ ID NO: 200146, a HCDR2 comprising SEQ ID NO: 200147, a HCDR3 comprising SEQ ID NO: 200148, a LCDR1 comprising SEQ ID NO: 200149, a LCDR2 comprising SEQ ID NO: 200150, and a LCDR3 comprising SEQ ID NO: 200151. In some cases, the anti-TL1A antibody comprises a heavy chain (HC) variable domain comprising SEQ ID NO: 200152 and a light chain (LC) variable domain comprising SEQ ID NO: 200153.

In some embodiments, the anti-TL1A antibody comprises a HCDR1 comprising SEQ ID NO: 200154, a HCDR2 comprising SEQ ID NO: 200155, a HCDR3 comprising SEQ ID NO: 200156, a LCDR1 comprising SEQ ID NO: 200157, a LCDR2 comprising SEQ ID NO: 200158, and a LCDR3 comprising SEQ ID NO: 200159. In some cases, the anti-TL1A antibody comprises a heavy chain (HC) variable domain comprising SEQ ID NO: 200160 and a light chain (LC) variable domain comprising SEQ ID NO: 200161.

In some embodiments, the anti-TL1A antibody comprises a HCDR1 comprising SEQ ID NO: 200162, a HCDR2 comprising SEQ ID NO: 200164, a HCDR3 comprising SEQ ID NO: 200165, a LCDR1 comprising SEQ ID NO: 200167, a LCDR2 comprising SEQ ID NO: 200169, and a LCDR3 comprising SEQ ID NO: 200170. In some cases, the anti-TL1A antibody comprises a heavy chain (HC) variable domain comprising SEQ ID NO: 200171 and a light chain (LC) variable domain comprising SEQ ID NO: 200175. In some cases, the anti-TLA antibody comprises a heavy chain (HC) variable domain comprising SEQ ID NO: 200171 and a light chain (LC) variable domain comprising SEQ ID NO: 200176. In some cases, the anti-TL1A antibody comprises a heavy chain (HC) variable domain comprising SEQ ID NO: 200171 and a light chain (LC) variable domain comprising SEQ ID NO: 200177. In some cases, the anti-TL1A antibody comprises a heavy chain (HC) variable domain comprising SEQ ID NO: 200171 and a light chain (LC) variable domain comprising SEQ ID NO: 200178.

In some embodiments, the anti-TL1A antibody comprises a HCDR1 comprising SEQ ID NO: 200162, a HCDR2 comprising SEQ ID NO: 200164, a HCDR3 comprising SEQ ID NO: 200165, a LCDR1 comprising SEQ ID NO: 200168, a LCDR2 comprising SEQ ID NO: 200169, and a LCDR3 comprising SEQ ID NO: 200170. In some cases, the anti-TL1A antibody comprises a heavy chain (HC) variable domain comprising SEQ ID NO: 200171 and a light chain (LC) variable domain comprising SEQ ID NO: 200179. In some cases, the anti-TLA antibody comprises a heavy chain (HC) variable domain comprising SEQ ID NO: 200171 and a light chain (LC) variable domain comprising SEQ ID NO: 200180. In some cases, the anti-TL1A antibody comprises a heavy chain (HC) variable domain comprising SEQ ID NO: 200171 and a light chain (LC) variable domain comprising SEQ ID NO: 200181. In some cases, the anti-TL1A antibody comprises a heavy chain (HC) variable domain comprising SEQ ID NO: 200171 and a light chain (LC) variable domain comprising SEQ ID NO: 200182.

In some embodiments, the anti-TL1A antibody comprises a HCDR1 comprising SEQ ID NO: 200162, a HCDR2 comprising SEQ ID NO: 200164, a HCDR3 comprising SEQ ID NO: 200165, a LCDR1 comprising SEQ ID NO: 200167, a LCDR2 comprising SEQ ID NO: 200169, and a LCDR3 comprising SEQ ID NO: 200170. In some cases, the anti-TL1A antibody comprises a heavy chain (HC) variable domain comprising SEQ ID NO: 200172 and a light chain (LC) variable domain comprising SEQ ID NO: 200175. In some cases, the anti-TLA antibody comprises a heavy chain (HC) variable domain comprising SEQ ID NO: 200172 and a light chain (LC) variable domain comprising SEQ ID NO: 200176. In some cases, the anti-TL1A antibody comprises a heavy chain (HC) variable domain comprising SEQ ID NO: 200172 and a light chain (LC) variable domain comprising SEQ ID NO: 200177. In some cases, the anti-TL1A antibody comprises a heavy chain (HC) variable domain comprising SEQ ID NO: 200172 and a light chain (LC) variable domain comprising SEQ ID NO: 200178.

In some embodiments, the anti-TL1A antibody comprises a HCDR1 comprising SEQ ID NO: 200162, a HCDR2 comprising SEQ ID NO: 200164, a HCDR3 comprising SEQ ID NO: 200165, a LCDR1 comprising SEQ ID NO: 200168, a LCDR2 comprising SEQ ID NO: 200169, and a LCDR3 comprising SEQ ID NO: 200170. In some cases, the anti-TL1A antibody comprises a heavy chain (HC) variable domain comprising SEQ ID NO: 200172 and a light chain (LC) variable domain comprising SEQ ID NO: 200179. In some cases, the anti-TLA antibody comprises a heavy chain (HC) variable domain comprising SEQ ID NO: 200172 and a light chain (LC) variable domain comprising SEQ ID NO: 200180. In some cases, the anti-TL1A antibody comprises a heavy chain (HC) variable domain comprising SEQ ID NO: 200172 and a light chain (LC) variable domain comprising SEQ ID NO: 200181. In some cases, the anti-TL1A antibody comprises a heavy chain (HC) variable domain comprising SEQ ID NO: 200172 and a light chain (LC) variable domain comprising SEQ ID NO: 200182.

In some embodiments, the anti-TL1A antibody comprises a HCDR1 comprising SEQ ID NO: 200163, a HCDR2 comprising SEQ ID NO: 200164, a HCDR3 comprising SEQ ID NO: 200166, a LCDR1 comprising SEQ ID NO: 200167, a LCDR2 comprising SEQ ID NO: 200169, and a LCDR3 comprising SEQ ID NO: 200170. In some cases, the anti-TL1A antibody comprises a heavy chain (HC) variable domain comprising SEQ ID NO: 200173 and a light chain (LC) variable domain comprising SEQ ID NO: 200175. In some cases, the anti-TLA antibody comprises a heavy chain (HC) variable domain comprising SEQ ID NO: 200173 and a light chain (LC) variable domain comprising SEQ ID NO: 200176. In some cases, the anti-TL1A antibody comprises a heavy chain (HC) variable domain comprising SEQ ID NO: 200173 and a light chain (LC) variable domain comprising SEQ ID NO: 200177. In some cases, the anti-TL1A antibody comprises a heavy chain (HC) variable domain comprising SEQ ID NO: 200173 and a light chain (LC) variable domain comprising SEQ ID NO: 200178. In some cases, the anti-TL1A antibody comprises a heavy chain (HC) variable domain comprising SEQ ID NO: 200173 and a light chain (LC) variable domain comprising SEQ ID NO: 200179. In some cases, the anti-TL1A antibody comprises a heavy chain (HC) variable domain comprising SEQ ID NO: 200173 and a light chain (LC) variable domain comprising SEQ ID NO: 200180. In some cases, the anti-TL1A antibody comprises a heavy chain (HC) variable domain comprising SEQ ID NO: 200173 and a light chain (LC) variable domain comprising SEQ ID NO: 200181. In some cases, the anti-TL1A antibody comprises a heavy chain (HC) variable domain comprising SEQ ID NO: 200173 and a light chain (LC) variable domain comprising SEQ ID NO: 200182.

In some embodiments, the anti-TL1A antibody comprises a HCDR1 comprising SEQ ID NO: 200163, a HCDR2 comprising SEQ ID NO: 200164, a HCDR3 comprising SEQ ID NO: 200166, a LCDR1 comprising SEQ ID NO: 200168, a LCDR2 comprising SEQ ID NO: 200169, and a LCDR3 comprising SEQ ID NO: 200170. In some cases, the anti-TL1A antibody comprises a heavy chain (HC) variable domain comprising SEQ ID NO: 200174 and a light chain (LC) variable domain comprising SEQ ID NO: 200179. In some cases, the anti-TL1A antibody comprises a heavy chain (HC) variable domain comprising SEQ ID NO: 200174 and a light chain (LC) variable domain comprising SEQ ID NO: 200180. In some cases, the anti-TL1A antibody comprises a heavy chain (HC) variable domain comprising SEQ ID NO: 200174 and a light chain (LC) variable domain comprising SEQ ID NO: 200181. In some cases, the anti-TL1A antibody comprises a heavy chain (HC) variable domain comprising SEQ ID NO: 200174 and a light chain (LC) variable domain comprising SEQ ID NO: 200182. In some cases, the anti-TL1A antibody comprises a heavy chain (HC) variable domain comprising SEQ ID NO: 200174 and a light chain (LC) variable domain comprising SEQ ID NO: 200175. In some cases, the anti-TL1A antibody comprises a heavy chain (HC) variable domain comprising SEQ ID NO: 200174 and a light chain (LC) variable domain comprising SEQ ID NO: 200176. In some cases, the anti-TL1A antibody comprises a heavy chain (HC) variable domain comprising SEQ ID NO: 200174 and a light chain (LC) variable domain comprising SEQ ID NO: 200177. In some cases, the anti-TL1A antibody comprises a heavy chain (HC) variable domain comprising SEQ ID NO: 200174 and a light chain (LC) variable domain comprising SEQ ID NO: 200178.

In some embodiments, the anti-TL1A antibody comprises a HCDR1 comprising SEQ ID NO: 200183, a HCDR2 comprising SEQ ID NO: 200184, a HCDR3 comprising SEQ ID NO: 200185, a LCDR1 comprising SEQ ID NO: 200186, a LCDR2 comprising SEQ ID NO: 200187, and a LCDR3 comprising SEQ ID NO: 200188. In some cases, the anti-TL1A antibody comprises a heavy chain (HC) variable domain comprising SEQ ID NO: 200189 and a light chain (LC) variable domain comprising SEQ ID NO: 200194. In some cases, the anti-TL1A antibody comprises a heavy chain (HC) variable domain comprising SEQ ID NO: 200189 and a light chain (LC) variable domain comprising SEQ ID NO: 200195. In some cases, the anti-TL1A antibody comprises a heavy chain (HC) variable domain comprising SEQ ID NO: 200189 and a light chain (LC) variable domain comprising SEQ ID NO: 200196. In some cases, the anti-TL1A antibody comprises a heavy chain (HC) variable domain comprising SEQ ID NO: 200189 and a light chain (LC) variable domain comprising SEQ ID NO: 200197. In some cases, the anti-TL1A antibody comprises a heavy chain (HC) variable domain comprising SEQ ID NO: 200190 and a light chain (LC) variable domain comprising SEQ ID NO: 200194. In some cases, the anti-TLA antibody comprises a heavy chain (HC) variable domain comprising SEQ ID NO: 200190 and a light chain (LC) variable domain comprising SEQ ID NO: 200195. In some cases, the anti-TL1A antibody comprises a heavy chain (HC) variable domain comprising SEQ ID NO: 200190 and a light chain (LC) variable domain comprising SEQ ID NO: 200196. In some cases, the anti-TL1A antibody comprises a heavy chain (HC) variable domain comprising SEQ ID NO: 200190 and a light chain (LC) variable domain comprising SEQ ID NO: 200197. In some cases, the anti-TL1A antibody comprises a heavy chain (HC) variable domain comprising SEQ ID NO: 200191 and a light chain (LC) variable domain comprising SEQ ID NO: 200194. In some cases, the anti-TL1A antibody comprises a heavy chain (HC) variable domain comprising SEQ ID NO: 200191 and a light chain (LC) variable domain comprising SEQ ID NO: 200195. In some cases, the anti-TL1A antibody comprises a heavy chain (HC) variable domain comprising SEQ ID NO: 200191 and a light chain (LC) variable domain comprising SEQ ID NO: 200196. In some cases, the anti-TL1A antibody comprises a heavy chain (HC) variable domain comprising SEQ ID NO: 200191 and a light chain (LC) variable domain comprising SEQ ID NO: 200197. In some cases, the anti-TL1A antibody comprises a heavy chain (HC) variable domain comprising SEQ ID NO: 200192 and a light chain (LC) variable domain comprising SEQ ID NO: 200194. In some cases, the anti-TLA antibody comprises a heavy chain (HC) variable domain comprising SEQ ID NO: 200192 and a light chain (LC) variable domain comprising SEQ ID NO: 200195. In some cases, the anti-TL1A antibody comprises a heavy chain (HC) variable domain comprising SEQ ID NO: 200192 and a light chain (LC) variable domain comprising SEQ ID NO: 200196. In some cases, the anti-TL1A antibody comprises a heavy chain (HC) variable domain comprising SEQ ID NO: 200192 and a light chain (LC) variable domain comprising SEQ ID NO: 200197. In some cases, the anti-TL1A antibody comprises a heavy chain (HC) variable domain comprising SEQ ID NO: 200193 and a light chain (LC) variable domain comprising SEQ ID NO: 200194. In some cases, the anti-TL1A antibody comprises a heavy chain (HC) variable domain comprising SEQ ID NO: 200193 and a light chain (LC) variable domain comprising SEQ ID NO: 200195. In some cases, the anti-TL1A antibody comprises a heavy chain (HC) variable domain comprising SEQ ID NO: 200193 and a light chain (LC) variable domain comprising SEQ ID NO: 200196. In some cases, the anti-TL1A antibody comprises a heavy chain (HC) variable domain comprising SEQ ID NO: 200193 and a light chain (LC) variable domain comprising SEQ ID NO: 200197.

In some embodiments, the anti-TL1A antibody comprises a HCDR1 comprising SEQ ID NO: 200198, a HCDR2 comprising SEQ ID NO: 200199, a HCDR3 comprising SEQ ID NO: 200200, a LCDR1 comprising SEQ ID NO: 200201, a LCDR2 comprising SEQ ID NO: 200202, and a LCDR3 comprising SEQ ID NO: 200203. In some cases, the anti-TL1A antibody comprises a heavy chain (HC) variable domain comprising SEQ ID NO: 200204 and a light chain (LC) variable domain comprising SEQ ID NO: 200205. In some cases, the anti-TL1A antibody comprises a heavy chain (HC) variable domain comprising SEQ ID NO: 200206 and a light chain (LC) variable domain comprising SEQ ID NO: 200207. In some cases, the anti-TL1A antibody comprises a heavy chain (HC) variable domain comprising SEQ ID NO: 200208 and a light chain (LC) variable domain comprising SEQ ID NO: 200209. In some cases, the anti-TL1A antibody comprises a heavy chain (HC) variable domain comprising SEQ ID NO: 200210 and a light chain (LC) variable domain comprising SEQ ID NO: 200211. In some cases, the anti-TL1A antibody comprises a heavy chain (HC) variable domain comprising SEQ ID NO: 200212 and a light chain (LC) variable domain comprising SEQ ID NO: 200213. In some cases, the anti-TL1A antibody comprises a heavy chain (HC) variable domain comprising SEQ ID NO: 200214 and a light chain (LC) variable domain comprising SEQ ID NO: 200215. In some cases, the anti-TL1A antibody comprises a heavy chain (HC) variable domain comprising SEQ ID NO: 200216 and a light chain (LC) variable domain comprising SEQ ID NO: 200217. In some cases, the anti-TL1A antibody comprises a heavy chain (HC) variable domain comprising SEQ ID NO: 200218 and a light chain (LC) variable domain comprising SEQ ID NO: 200219. In some cases, the anti-TL1A antibody comprises a heavy chain (HC) variable domain comprising SEQ ID NO: 200220 and a light chain (LC) variable domain comprising SEQ ID NO: 200221. In some cases, the anti-TL1A antibody comprises a heavy chain (HC) variable domain comprising SEQ ID NO: 200222 and a light chain (LC) variable domain comprising SEQ ID NO: 200223. In some cases, the anti-TL1A antibody comprises a heavy chain (HC) variable domain comprising SEQ ID NO: 200224 and a light chain (LC) variable domain comprising SEQ ID NO: 200225. In some cases, the anti-TL1A antibody comprises a heavy chain (HC) variable domain comprising SEQ ID NO: 200226 and a light chain (LC) variable domain comprising SEQ ID NO: 200227.

In some embodiments, the anti-TL1A antibody comprises a HCDR1 comprising SEQ ID NO: 200228, a HCDR2 comprising SEQ ID NO: 200229, a HCDR3 comprising SEQ ID NO: 200230, a LCDR1 comprising SEQ ID NO: 200231, a LCDR2 comprising SEQ ID NO: 200232, and a LCDR3 comprising SEQ ID NO: 200233. In some cases, the anti-TL1A antibody comprises a heavy chain (HC) variable domain comprising SEQ ID NO: 200234 and a light chain (LC) variable domain comprising SEQ ID NO: 200235.

In some embodiments, the anti-TL1A antibody comprises a HCDR1 comprising SEQ ID NO: 200236, a HCDR2 comprising SEQ ID NO: 200237, a HCDR3 comprising SEQ ID NO: 200238, a LCDR1 comprising SEQ ID NO: 200239, a LCDR2 comprising SEQ ID NO: 200240, and a LCDR3 comprising SEQ ID NO: 200241. In some cases, the anti-TL1A antibody comprises a heavy chain (HC) variable domain comprising SEQ ID NO: 200242 and a light chain (LC) variable domain comprising SEQ ID NO: 200243.

In some embodiments, the anti-TL1A antibody comprises a HCDR1 comprising SEQ ID NO: 200246, a HCDR2 comprising SEQ ID NO: 200247, a HCDR3 comprising SEQ ID NO: 200248, a LCDR1 comprising SEQ ID NO: 200249, a LCDR2 comprising SEQ ID NO: 200250, and a LCDR3 comprising SEQ ID NO: 200251. In some cases, the anti-TL1A antibody comprises a heavy chain (HC) variable domain comprising SEQ ID NO: 200244 and a light chain (LC) variable domain comprising SEQ ID NO: 200245. In some cases, the anti-TL1A antibody comprises a heavy chain (HC) variable domain comprising SEQ ID NO: 200252 and a light chain (LC) variable domain comprising SEQ ID NO: 200253. In some cases, the anti-TL1A antibody comprises a heavy chain (HC) variable domain comprising SEQ ID NO: 200254 and a light chain (LC) variable domain comprising SEQ ID NO: 200255. In some cases, the anti-TL1A antibody comprises a heavy chain (HC) variable domain comprising SEQ ID NO: 200256 and a light chain (LC) variable domain comprising SEQ ID NO: 200257.

In some embodiments, the anti-TL1A antibody comprises a HCDR1 comprising SEQ ID NO: 200276, a HCDR2 comprising SEQ ID NO: 200277, a HCDR3 comprising SEQ ID NO: 200278, a LCDR1 comprising SEQ ID NO: 200279, a LCDR2 comprising SEQ ID NO: 200280, and a LCDR3 comprising SEQ ID NO: 200281. In some cases, the anti-TLA antibody comprises a heavy chain (HC) variable domain comprising SEQ ID NO: 200282 and a light chain (LC) variable domain comprising SEQ ID NO: 200283.

In some embodiments, the anti-TL1A antibody comprises a HCDR1 comprising SEQ ID NO: 200284, a HCDR2 comprising SEQ ID NO: 200285, a HCDR3 comprising SEQ ID NO: 200286, a LCDR1 comprising SEQ ID NO: 200287, a LCDR2 comprising SEQ ID NO: 200288, and a LCDR3 comprising SEQ ID NO: 200299. In some cases, the anti-TLA antibody comprises a heavy chain (HC) variable domain comprising SEQ ID NO: 200290 and a light chain (LC) variable domain comprising SEQ ID NO: 200291.

In some embodiments, the anti-TL1A antibody comprises one or more of A101-A177 of Table 15. In some embodiments, the anti-TL1A antibody is A100. In some embodiments, the anti-TL1A antibody is A101. In some embodiments, the anti-TL1A antibody is A102. In some embodiments, the anti-TL1A antibody is A103. In some embodiments, the anti-TL1A antibody is A104. In some embodiments, the anti-TLA antibody is A105. In some embodiments, the anti-TL1A antibody is A106. In some embodiments, the anti-TL1A antibody is A107. In some embodiments, the anti-TL1A antibody is A108. In some embodiments, the anti-TL1A antibody is A109. In some embodiments, the anti-TL1A antibody is A110. In some embodiments, the anti-TL1A antibody is A11. In some embodiments, the anti-TL1A antibody is A112. In some embodiments, the anti-TL1A antibody is A113. In some embodiments, the anti-TLA antibody is A114. In some embodiments, the anti-TL1A antibody is A115. In some embodiments, the anti-TL1A antibody is A116. In some embodiments, the anti-TLA antibody is A117. In some embodiments, the anti-TL1A antibody is A118. In some embodiments, the anti-TL1A antibody is A119. In some embodiments, the anti-TL1A antibody is A120. In some embodiments, the anti-TL1A antibody is A121. In some embodiments, the anti-TL1A antibody is A122. In some embodiments, the anti-TLA antibody is A123. In some embodiments, the anti-TL1A antibody is A124. In some embodiments, the anti-TL1A antibody is A125. In some embodiments, the anti-TL1A antibody is A126. In some embodiments, the anti-TL1A antibody is A127. In some embodiments, the anti-TL1A antibody is A128. In some embodiments, the anti-TL1A antibody is A129. In some embodiments, the anti-TL1A antibody is A130. In some embodiments, the anti-TL1A antibody is A131. In some embodiments, the anti-TLA antibody is A132. In some embodiments, the anti-TL1A antibody is A133. In some embodiments, the anti-TL1A antibody is A134. In some embodiments, the anti-TL1A antibody is A135. In some embodiments, the anti-TL1A antibody is A136. In some embodiments, the anti-TL1A antibody is A137. In some embodiments, the anti-TL1A antibody is A138. In some embodiments, the anti-TL1A antibody is A139. In some embodiments, the anti-TL1A antibody is A140. In some embodiments, the anti-TLA antibody is A141. In some embodiments, the anti-TL1A antibody is A142. In some embodiments, the anti-TL1A antibody is A143. In some embodiments, the anti-TLA antibody is A144. In some embodiments, the anti-TL1A antibody is A145. In some embodiments, the anti-TL1A antibody is A146. In some embodiments, the anti-TL1A antibody is A147. In some embodiments, the anti-TL1A antibody is A148. In some embodiments, the anti-TL1A antibody is A149. In some embodiments, the anti-TLA antibody is A150. In some embodiments, the anti-TL1A antibody is A151. In some embodiments, the anti-TL1A antibody is A152. In some embodiments, the anti-TLA antibody is A153. In some embodiments, the anti-TL1A antibody is A154. In some embodiments, the anti-TL1A antibody is A155. In some embodiments, the anti-TL1A antibody is A156. In some embodiments, the anti-TL1A antibody is A157. In some embodiments, the anti-TL1A antibody is A158. In some embodiments, the anti-TLA antibody is A159. In some embodiments, the anti-TL1A antibody is A160. In some embodiments, the anti-TL1A antibody is A161. In some embodiments, the anti-TLA antibody is A162. In some embodiments, the anti-TL1A antibody is A163. In some embodiments, the anti-TL1A antibody is A164. In some embodiments, the anti-TL1A antibody is A165. In some embodiments, the anti-TL1A antibody is A166. In some embodiments, the anti-TL1A antibody is A167. In some embodiments, the anti-TLA antibody is A168. In some embodiments, the anti-TL1A antibody is A169. In some embodiments, the anti-TL1A antibody is A170. In some embodiments, the anti-TL1A antibody is A171. In some embodiments, the anti-TL1A antibody is A172. In some embodiments, the anti-TL1A antibody is A173. In some embodiments, the anti-TL1A antibody is A174. In some embodiments, the anti-TL1A antibody is A175. In some embodiments, the anti-TL1A antibody is A176. In some embodiments, the anti-TL1A antibody is A177.

In some embodiments, the anti-DR3 is A178. In some embodiments, the anti-DR3 is A179. In some embodiments, the anti-DR3 is A180. In some embodiments, the anti-DR3 is A181. In some embodiments, the anti-DR3 is A182. In some embodiments, the anti-DR3 is A183. In some embodiments, the anti-DR3 is A184. In some embodiments, the anti-DR3 is A185. In some embodiments, the anti-DR3 is A186. In some embodiments, the anti-DR3 is A187. In some embodiments, the anti-DR3 is A188. In some embodiments, the anti-DR3 is A189. In some embodiments, the anti-DR3 is A190. In some embodiments, the anti-DR3 is A191. In some embodiments, the anti-DR3 is A192. In some embodiments, the anti-DR3 is A193. In some embodiments, the anti-DR3 is A194. In some embodiments, the anti-DR3 is A195. In some embodiments, the anti-DR3 is A196. In some embodiments, the anti-DR3 is A197. In some embodiments, the anti-DR3 is A198. In some embodiments, the anti-DR3 is A199. In some embodiments, the anti-DR3 is A200. In some embodiments, the anti-DR3 is A201. In some embodiments, the anti-DR3 is A202. In some embodiments, the anti-DR3 is A203. In some embodiments, the anti-DR3 is A204. In some embodiments, the anti-DR3 is A205. In some embodiments, the anti-DR3 is A206. In some embodiments, the anti-DR3 is A207. In some embodiments, the anti-DR3 is A208. In some embodiments, the anti-DR3 is A209. In some embodiments, the anti-DR3 is A210. In some embodiments, the anti-DR3 is A211. In some embodiments, the anti-DR3 is A212. In some embodiments, the anti-DR3 is A213. In some embodiments, the anti-DR3 is A214. In some embodiments, the anti-DR3 is A215. In some embodiments, the anti-DR3 is A216. In some embodiments, the anti-DR3 is A217. In some embodiments, the anti-DR3 is A218. In some embodiments, the anti-DR3 is A219. In some embodiments, the anti-DR3 is A220. In some embodiments, the anti-DR3 is A221. In some embodiments, the anti-DR3 is A222. In some embodiments, the anti-DR3 is A223. In some embodiments, the anti-DR3 is A224. In some embodiments, the anti-DR3 is A225. In some embodiments, the anti-DR3 is A226. In some embodiments, the anti-DR3 is A227. In some embodiments, the anti-DR3 is A228. In some embodiments, the anti-DR3 is A229. In some embodiments, the anti-DR3 is A230. In some embodiments, the anti-DR3 is A231. In some embodiments, the anti-DR3 is A232. In some embodiments, the anti-DR3 is A233. In some embodiments, the anti-DR3 is A234. In some embodiments, the anti-DR3 is A235. In some embodiments, the anti-DR3 is A236. In some embodiments, the anti-DR3 is A237. In some embodiments, the anti-DR3 is A238. In some embodiments, the anti-DR3 is A239. In some embodiments, the anti-DR3 is A240. In some embodiments, the anti-DR3 is A241. In some embodiments, the anti-DR3 is A242.

TABLE 15

Non-Limiting Examples of anti-TL1A and anti-DR3 Antibodies

| Antibody Name | HC Variable Domain (SEQ ID NO) | LC Variable Domain (SEQ ID NO) |
|---|---|---|
| A100 | 200115 | 200116 |
| A101 | 200123 | 200124 |
| A102 | 200131 | 200132 |
| A103 | 200142 | 200143 |
| A104 | 200152 | 200153 |
| A105 | 200160 | 200161 |
| A106 | 200171 | 200175 |
| A107 | 200171 | 200176 |
| A108 | 200171 | 200177 |
| A109 | 200171 | 200178 |
| A110 | 200171 | 200179 |
| A111 | 200171 | 200180 |
| A112 | 200171 | 200181 |
| A113 | 200171 | 200182 |
| A114 | 200172 | 200175 |
| A115 | 200172 | 200176 |
| A116 | 200172 | 200177 |
| A117 | 200172 | 200178 |
| A118 | 200172 | 200179 |
| A119 | 200172 | 200180 |
| A120 | 200172 | 200181 |
| A121 | 200172 | 200182 |
| A122 | 200173 | 200175 |
| A123 | 200173 | 200176 |
| A124 | 200173 | 200177 |
| A125 | 200173 | 200178 |
| A126 | 200173 | 200179 |
| A127 | 200173 | 200180 |
| A128 | 200173 | 200181 |
| A129 | 200173 | 200182 |
| A130 | 200174 | 200175 |
| A131 | 200174 | 200176 |
| A132 | 200174 | 200177 |
| A133 | 200174 | 200178 |
| A134 | 200174 | 200179 |
| A135 | 200174 | 200180 |
| A136 | 200174 | 200181 |
| A137 | 200174 | 200182 |
| A138 | 200189 | 200194 |
| A139 | 200189 | 200195 |
| A140 | 200189 | 200196 |
| A141 | 200189 | 200197 |
| A142 | 200190 | 200194 |
| A143 | 200190 | 200195 |
| A144 | 200190 | 200196 |
| A145 | 200190 | 200197 |
| A146 | 200191 | 200194 |
| A147 | 200191 | 200195 |
| A148 | 200191 | 200196 |
| A149 | 200191 | 200197 |
| A150 | 200192 | 200194 |
| A151 | 200192 | 200195 |
| A152 | 200192 | 200196 |
| A153 | 200192 | 200197 |
| A154 | 200193 | 200194 |
| A155 | 200193 | 200195 |
| A156 | 200193 | 200196 |
| A157 | 200193 | 200197 |
| A158 | 200204 | 200205 |
| A159 | 200206 | 200207 |
| A160 | 200208 | 200209 |
| A161 | 200210 | 200211 |
| A162 | 200212 | 200213 |
| A163 | 200214 | 200215 |
| A164 | 200216 | 200217 |
| A165 | 200218 | 200219 |
| A166 | 200220 | 200221 |
| A167 | 200222 | 200223 |
| A168 | 200224 | 200225 |
| A169 | 200226 | 200227 |
| A170 | 200234 | 200235 |

TABLE 15-continued

Non-Limiting Examples of anti-TL1A and anti-DR3 Antibodies

| Antibody Name | HC Variable Domain (SEQ ID NO) | LC Variable Domain (SEQ ID NO) |
|---|---|---|
| A171 | 200242 | 200243 |
| A172 | 200244 | 200245 |
| A173 | 200252 | 200253 |
| A174 | 200254 | 200255 |
| A175 | 200256 | 200257 |
| A176 | 200282 | 200283 |
| A177 | 200290 | 200291 |
| A178 | 200258 | 200271 |
| A179 | 200258 | 200272 |
| A180 | 200258 | 200273 |
| A181 | 200258 | 200274 |
| A182 | 200258 | 200275 |
| A183 | 200259 | 200271 |
| A184 | 200259 | 200272 |
| A185 | 200259 | 200273 |
| A186 | 200259 | 200274 |
| A187 | 200259 | 200275 |
| A188 | 200260 | 200271 |
| A189 | 200260 | 200272 |
| A190 | 200260 | 200273 |
| A191 | 200260 | 200274 |
| A192 | 200260 | 200275 |
| A193 | 200261 | 200271 |
| A194 | 200261 | 200272 |
| A195 | 200261 | 200273 |
| A196 | 200261 | 200274 |
| A197 | 200261 | 200275 |
| A198 | 200262 | 200271 |
| A199 | 200262 | 200272 |
| A200 | 200262 | 200273 |
| A201 | 200262 | 200274 |
| A202 | 200262 | 200275 |
| A203 | 200263 | 200271 |
| A204 | 200263 | 200272 |
| A205 | 200263 | 200273 |
| A206 | 200263 | 200274 |
| A207 | 200263 | 200275 |
| A208 | 200264 | 200271 |
| A209 | 200264 | 200272 |
| A210 | 200264 | 200273 |
| A211 | 200264 | 200274 |
| A212 | 200264 | 200275 |
| A213 | 200265 | 200271 |
| A214 | 200265 | 200272 |
| A215 | 200265 | 200273 |
| A216 | 200265 | 200274 |
| A217 | 200265 | 200275 |
| A218 | 200266 | 200271 |
| A219 | 200266 | 200272 |
| A220 | 200266 | 200273 |
| A221 | 200266 | 200274 |
| A222 | 200266 | 200275 |
| A223 | 200267 | 200271 |
| A224 | 200267 | 200272 |
| A225 | 200267 | 200273 |
| A226 | 200267 | 200274 |
| A227 | 200267 | 200275 |
| A228 | 200268 | 200271 |
| A229 | 200268 | 200272 |
| A230 | 200268 | 200273 |
| A231 | 200268 | 200274 |
| A232 | 200268 | 200275 |
| A233 | 200269 | 200271 |
| A234 | 200269 | 200272 |
| A235 | 200269 | 200273 |
| A236 | 200269 | 200274 |
| A237 | 200269 | 200275 |
| A238 | 200270 | 200271 |
| A239 | 200270 | 200272 |
| A240 | 200270 | 200273 |
| A241 | 200270 | 200274 |
| A242 | 200270 | 200275 |

In some cases, the anti-TL1A antibody binds to at least one or more of the same residues of human TL1A as an antibody described herein. For example, the anti-TL1A antibody binds to at least one or more of the same residues of human TL1A as an antibody selected from A100-A177 of Table 17. In some cases, the anti-TLA antibody binds to the same epitope of human TL1A as an antibody selected from A100-A177. In some cases, the anti-TL1A antibody binds to the same region of human TL1A as an antibody selected from A100-A177.

In certain embodiments, the anti-TL1A antibody or antigen binding fragment comprises (a) a heavy chain variable region comprising an amino acid sequence at least about 85%, 90%, 95%, 97%, 98%, 99%, or 100% identical to any one of SEQ ID NOs: 491, 493, 495, 497, 499, 501, 503, 505, 507, 509, 511, 513, 515, 517, 519, 521, 523, 525, 527, 529, 531, 533, 535, 537, 539, or 541; and (b) a light chain variable region comprising an amino acid sequence at least about 85%, 90%, 95%, 97%, 98%, 99%, or 100% identical to any one of SEQ ID NOs: 490, 492, 494, 496, 498, 500, 502, 504, 506, 508, 510, 512, 514, 516, 518, 520, 522, 524, 526, 528, 530, 532, 534, 536, 538, or 540.

In some embodiments, the anti-TLA antibody comprises any one of the following embodiments 1-547 below.

1. An antibody or antigen-binding fragment that specifically binds to TL1A, comprising:
   a heavy chain variable region comprising four heavy chain framework regions (HFR1, HFR2, HFR3, and HFR4), and three heavy chain complementarity-determining regions (HCDR1, HCDR2, and HCDR3), the heavy chain variable region comprising:
   (a) a HFR1 selected from: (i) a HFR1 comprising SEQ ID NO: 100100, (ii) a HFR1 comprising SEQ ID NO: 100108, and (iii) a HFR1 comprising an amino acid sequence that differs from a sequence selected from the group consisting of SEQ ID NOS: 100100 and 100108 by up to five, four, three, or two amino acids,
   (b) a HFR2 selected from: (i) a HFR2 comprising SEQ ID NO: 100101, and (ii) a HFR2 comprising an amino acid sequence that differs from SEQ ID NO: 100101 by up to five, four, three, or two amino acids,
   (c) a HFR3 selected from: (i) a HFR3 comprising SEQ ID NO: 100102, (ii) a HFR3 comprising SEQ ID NO: 100109, and (iii) a HFR3 comprising an amino acid sequence that differs from a sequence selected from the group consisting of SEQ ID NOS: 100102 and 100109 by up to five, four, three, or two amino acids,
   (d) a HFR4 selected from: (i) a HFR4 comprising SEQ ID NO: 100103, and (ii) a HFR4 comprising an amino acid sequence that differs from SEQ ID NO: 100103 by up to five, four, three, or two amino acids,
   (e) a HCDR1 selected from: (i) a HCDR1 comprising SEQ ID NO: 1009, (ii) a HCDR1 comprising SEQ ID NO: 100150, wherein $X_1$ is selected from D and E, $X_2$ is selected from I, P and V, $X_3$ is selected from G, Q, S, and V, $X_4$ is selected from F and Y, and $X_5$ is selected from I and M, (iii) a HCDR1 selected from SEQ ID NOS: 100200-100295, and (iv) a HCDR1 comprising an amino acid sequence that differs from a sequence selected from the group consisting of SEQ ID NOS: 1009, 100150 and 100200-295 by up to five, four, three, or two amino acids,
   (f) a HCDR2 selected from: (i) a HCDR2 comprising SEQ ID NO: 10012, and (ii) a HCDR2 comprising an amino acid sequence that differs from SEQ ID NO: 10012 by up to five, four, three, or two amino acids, and
   (g) a HCDR3 selected from (i) a HCDR3 comprising SEQ ID NO: 10015, (ii) a HCDR3 comprising SEQ ID NO: 100152, wherein $X_1$ is selected from L and M, and $X_2$ is selected from E, I, K, L, M, Q, T, V, W, and Y, (iii) a HCDR3 selected from SEQ ID NOS: 100296-100314, and (iv) a HCDR3 comprising an amino acid sequence that differs from a sequence selected from the group consisting of SEQ ID NOS: 10015, 100152 and 100296-100314 by up to five, four, three, or two amino acids; and a light chain variable region comprising four light chain framework regions (LFR1, LFR2, LFR3, and LFR4), and three light chain complementarity-determining regions (LCDR1, LCDR2, and LCDR3), the light chain variable region comprising:
- (a) a LFR1 selected from: (i) a LFR1 comprising SEQ ID NO: 100104, and (ii) a LFR1 comprising an amino acid sequence that differs from SEQ ID NO: 100104 by up to five, four, three, or two amino acids,
- (b) a LFR2 selected from: (i) a LFR2 comprising SEQ ID NO: 100105, and (ii) a LFR2 comprising an amino acid sequence that differs from SEQ ID NO: 100105 by up to five, four, three, or two amino acids,
- (c) a LFR3 selected from: (i) a LFR3 comprising SEQ ID NO: 100106, (ii) a LFR3 comprising SEQ ID NO: 100110, and (iii) a LFR3 comprising an amino acid sequence that differs from a sequence selected from the group consisting of SEQ ID NOS: 100106 and 100110 by up to five, four, three, or two amino acids,
- (d) a LFR4 selected from: (i) a LFR4 comprising SEQ ID NO: 100107, and (ii) a LFR4 comprising an amino acid sequence that differs from SEQ ID NO: 100107 by up to five, four, three, or two amino acids,
- (e) a LCDR1 selected from: (i) a LCDR1 comprising SEQ ID NO: 10018, and (ii) a LCDR1 comprising an amino acid sequence that differs from SEQ ID NO: 10018 by up to five, four, three, or two amino acids,
- (f) a LCDR2 selected from: (i) a LCDR2 comprising SEQ ID NO: 10021, and (ii) a LCDR2 comprising an amino acid sequence that differs from SEQ ID NO: 10021 by up to five, four, three, or two amino acids, and
- (g) a LCDR3 selected from (i) a LCDR3 comprising SEQ ID NO: 10024, (ii) a LCDR3 comprising SEQ ID NO: 100155, wherein $X_1$ is selected from Q and N, $X_2$ is selected from D, E, H, N, Q, and S, $X_3$ is selected from A and G, and $X_4$ is selected from D, F, K, N, R, S, and T, (iii) a LCDR3 selected from SEQ ID NOS: 100315-100482, and (iv) a LCDR3 comprising an amino acid sequence that differs from a sequence selected from the group consisting of SEQ ID NOS: 10024, 100155, and 100315-100482 by up to five, four, three, or two amino acids.

2. The antibody or antigen-binding fragment of embodiment 1, provided that the HFR1 comprises SEQ ID NO: 100100.

3. The antibody or antigen-binding fragment of embodiment 1, provided that the HFR1 comprises SEQ ID NO: 100108.

4. The antibody or antigen-binding fragment of embodiment 1, provided that the HFR1 comprises an amino acid sequence that differs from SEQ ID NO: 100100 by up to five, four, three, or two amino acids.

5. The antibody or antigen-binding fragment of embodiment 1, provided that the HFR1 comprises an amino acid sequence that differs from SEQ ID NO: 100108 by up to five, four, three, or two amino acids.

6. The antibody or antigen-binding fragment of any of embodiments 1-5, provided that the HFR2 comprises SEQ ID NO: 100101.

7. The antibody or antigen-binding fragment of any of embodiments 1-5, provided that the HFR2 comprises an amino acid sequence that differs from SEQ ID NO: 100101 by up to five, four, three, or two amino acids.

8. The antibody or antigen-binding fragment of any of embodiments 1-7, provided that the HFR3 comprises SEQ ID NO: 100102.

9. The antibody or antigen-binding fragment of any of embodiments 1-7, provided that the HFR3 comprises SEQ ID NO: 100109.

10. The antibody or antigen-binding fragment of any of embodiments 1-7, provided that the HFR3 comprises an amino acid sequence that differs from SEQ ID NO: 100102 by up to five, four, three, or two amino acids.

11. The antibody or antigen-binding fragment of any of embodiments 1-7, provided that the HFR3 comprises an amino acid sequence that differs from SEQ ID NO: 100109 by up to five, four, three, or two amino acids.

12. The antibody or antigen-binding fragment of any of embodiments 1-11, provided that the HFR4 comprises SEQ ID NO: 100103.

13. The antibody or antigen-binding fragment of any of embodiments 1-11, provided that the HFR4 comprises an amino acid sequence that differs from SEQ ID NO: 100103 by up to five, four, three, or two amino acids.

14. The antibody or antigen-binding fragment of any of embodiments 1-13, provided that the HCDR1 comprises SEQ ID NO: 1009.

15. The antibody or antigen-binding fragment of any of embodiments 1-13, provided that the HCDR1 comprises SEQ ID NO: 100150.

16. The antibody or antigen-binding fragment of embodiment 15, provided that $X_1$ is E.

17. The antibody or antigen-binding fragment of embodiment 15 or embodiment 16, provided that $X_2$ is selected from P and V.

18. The antibody or antigen-binding fragment of any of embodiments 15-17, provided that $X_3$ is selected from G, S, and V.

19. The antibody or antigen-binding fragment of any of embodiments 15-18, provided that $X_4$ is F.

20. The antibody or antigen-binding fragment of any of embodiments 15-19, provided that $X_5$ is I.

21. The antibody or antigen-binding fragment of any of embodiments 1-13, provided that the HCDR1 comprises an amino acid sequence selected from SEQ ID NOS: 100200-100295.

22. The antibody or antigen-binding fragment of any of embodiments 1-21, provided that the HCDR2 comprises SEQ ID NO: 10012.

23. The antibody or antigen-binding fragment of any of embodiments 1-21, provided that the HCDR2 comprises an amino acid sequence that differs from SEQ ID NO: 10012 by up to five, four, three, or two amino acids.

24. The antibody or antigen-binding fragment of any of embodiments 1-23, provided that the HCDR3 comprises SEQ ID NO: 10015.

25. The antibody or antigen-binding fragment of any of embodiments 1-23, provided that the HCDR3 comprises SEQ ID NO: 100152.

26. The antibody or antigen-binding fragment of embodiment 25, provided that $X_1$ is M.

27. The antibody or antigen-binding fragment of embodiment 25 or embodiment 26, provided that $X_2$ is selected from E, I, K, L, M, Q, T, W, and Y.

28. The antibody or antigen-binding fragment of any of embodiments 1-23, provided that the HCDR3 comprises a sequence selected from SEQ ID NOS: 100296-100314.
29. The antibody or antigen-binding fragment of any of embodiments 1-28, provided that the LFR1 comprises SEQ ID NO: 100104.
30. The antibody or antigen-binding fragment of any of embodiments 1-28, provided that the LFR1 comprises an amino acid sequence that differs from SEQ ID NO: 100104 by up to five, four, three, or two amino acids.
31. The antibody or antigen-binding fragment of any of embodiments 1-30, provided that the LFR2 comprises SEQ ID NO: 100105.
32. The antibody or antigen-binding fragment of any of embodiments 1-30, provided that the LFR2 comprises an amino acid sequence that differs from SEQ ID NO: 100105 by up to five, four, three, or two amino acids.
33. The antibody or antigen-binding fragment of any of embodiments 1-32, provided that the LFR3 comprises SEQ ID NO: 100106.
34. The antibody or antigen-binding fragment of any of embodiments 1-32, provided that the LFR3 comprises SEQ ID NO: 100110.
35. The antibody or antigen-binding fragment of any of embodiments 1-32, provided that the LFR3 comprises an amino acid sequence that differs from SEQ ID NO: 100106 by up to five, four, three, or two amino acids.
36. The antibody or antigen-binding fragment of any of embodiments 1-32, provided that the LFR3 comprises an amino acid sequence that differs from SEQ ID NO: 100110 by up to five, four, three, or two amino acids.
37. The antibody or antigen-binding fragment of any of embodiments 1-36, provided that the LFR4 comprises SEQ ID NO: 100107.
38. The antibody or antigen-binding fragment of any of embodiments 1-36, provided that the LFR4 comprises an amino acid sequence that differs from SEQ ID NO: 100107 by up to five, four, three, or two amino acids.
39. The antibody or antigen-binding fragment of any of embodiments 1-38, provided that the LCDR1 comprises SEQ ID NO: 10018.
40. The antibody or antigen-binding fragment of any of embodiments 1-38, provided that the LCDR1 comprises an amino acid sequence that differs from SEQ ID NO: 10018 by up to five, four, three, or two amino acids.
41. The antibody or antigen-binding fragment of any of embodiments 1-40, provided that the LCDR2 comprises SEQ ID NO: 10021.
42. The antibody or antigen-binding fragment of any of embodiments 1-40, provided that the LCDR2 comprises an amino acid sequence that differs from SEQ ID NO: 10021 by up to five, four, three, or two amino acids.
43. The antibody or antigen-binding fragment of any of embodiments 1-42, provided that the LCDR3 comprises SEQ ID NO: 10024.
44. The antibody or antigen-binding fragment of any of embodiments 1-42, provided that the LCDR3 comprises SEQ ID NO: 100155.
45. The antibody or antigen-binding fragment of embodiment 44, provided that $X_1$ is N.
46. The antibody or antigen-binding fragment of embodiment 44 or embodiment 45, provided that $X_2$ is selected from D, E, H, N, and Q.
47. The antibody or antigen-binding fragment of any of embodiments 44-46, provided that $X_3$ is A.
48. The antibody or antigen-binding fragment of any of embodiments 44-47, provided that $X_4$ is selected from D, F, K, R, S, and T.
49. The antibody or antigen-binding fragment of any of embodiments 1-42, provided that the LCDR3 comprises an amino acid sequence selected from SEQ ID NOS: 100315-100482.
50. The antibody or antigen-binding fragment of embodiment 1, provided that the HFR1 comprises SEQ ID NO: 100100, the HFR2 comprises SEQ ID NO: 100101, the HFR3 comprises SEQ ID NO: 100102, the HFR4 comprises SEQ ID NO: 100103, the LFR1 comprises SEQ ID NO: 100104, the LFR2 comprises SEQ ID NO: 100105, the LFR3 comprises SEQ ID NO: 100106, and the LFR4 comprises SEQ ID NO: 100107.
51. The antibody or antigen-binding fragment of embodiment 1, provided that the HFR1 comprises SEQ ID NO: 100108, the HFR2 comprises SEQ ID NO: 100101, the HFR3 comprises SEQ ID NO: 100109, the HFR4 comprises SEQ ID NO: 100103, the LFR1 comprises SEQ ID NO: 100104, the LFR2 comprises SEQ ID NO: 100105, the LFR3 comprises SEQ ID NO: 100110, and the LFR4 comprises SEQ ID NO: 100107.
52. The antibody or antigen-binding fragment of embodiment 1, provided that the HFR1 comprises SEQ ID NO: 100108, the HFR2 comprises SEQ ID NO: 100101, the HFR3 comprises SEQ ID NO: 100109, the HFR4 comprises SEQ ID NO: 100103, the LFR1 comprises SEQ ID NO: 100104, the LFR2 comprises SEQ ID NO: 100105, the LFR3 comprises SEQ ID NO: 100106, and the LFR4 comprises SEQ ID NO: 100107.
53. The antibody or antigen-binding fragment of any of embodiments 1 and 50-52, provided that the HCDR1 comprises SEQ ID NO: 1009, the HCDR2 comprises SEQ ID NO: 10012, the HCDR3 comprises SEQ ID NO: 10015, the LCDR1 comprises SEQ ID NO: 10018, the LCDR2 comprises SEQ ID NO: 10021, and the LCDR3 comprises SEQ ID NO: 10024.
54. The antibody or antigen-binding fragment of any of embodiments 1 and 50-52, provided that the HCDR1 comprises SEQ ID NO: 100150, the HCDR2 comprises SEQ ID NO: 10012, the HCDR3 comprises SEQ ID NO: 100152, the LCDR1 comprises SEQ ID NO: 10018, the LCDR2 comprises SEQ ID NO: 10021, and the LCDR3 comprises SEQ ID NO: 100155.
55. The antibody or antigen-binding fragment of embodiment 1, provided that the HFR1 comprises SEQ ID NO: 100100, the HFR2 comprises SEQ ID NO: 100101, the HFR3 comprises SEQ ID NO: 100102, the HFR4 comprises SEQ ID NO: 100103, the LFR1 comprises SEQ ID NO: 100104, the LFR2 comprises SEQ ID NO: 100105, the LFR3 comprises SEQ ID NO: 100106, the LFR4 comprises SEQ ID NO: 100107, the HCDR1 comprises SEQ ID NO: 1009, the HCDR2 comprises SEQ ID NO: 10012, the HCDR3 comprises SEQ ID NO: 10015, the LCDR1 comprises SEQ ID NO: 10018, the LCDR2 comprises SEQ ID NO: 10021, and the LCDR3 comprises SEQ ID NO: 10024.
56. The antibody or antigen-binding fragment of embodiment 1, provided that the HFR1 comprises SEQ ID NO: 100100, the HFR2 comprises SEQ ID NO: 100101, the HFR3 comprises SEQ ID NO: 100102, the HFR4 comprises SEQ ID NO: 100103, the LFR1 comprises SEQ ID NO: 100104, the LFR2 comprises SEQ ID NO: 100105, the LFR3 comprises SEQ ID NO: 100106, the LFR4 comprises SEQ ID NO: 100107, the HCDR1 comprises SEQ ID NO: 100150, the HCDR2 comprises SEQ ID NO: 10012, the HCDR3 comprises SEQ ID NO: 100152, the LCDR1 comprises SEQ ID NO 10018, the LCDR2 comprises SEQ ID NO: 10021, and the LCDR3 comprises SEQ ID NO: 100155.

57. The antibody or antigen-binding fragment of embodiment 1, provided that the HFR1 comprises SEQ ID NO: 100108, the HFR2 comprises SEQ ID NO: 100101, the HFR3 comprises SEQ ID NO: 100109, the HFR4 comprises SEQ ID NO: 100103, the LFR1 comprises SEQ ID NO: 100104, the LFR2 comprises SEQ ID NO: 100105, the LFR3 comprises SEQ ID NO: 100110, the LFR4 comprises SEQ ID NO: 100107, the HCDR1 comprises SEQ ID NO: 1009, the HCDR2 comprises SEQ ID NO: 10012, the HCDR3 comprises SEQ ID NO: 10015, the LCDR1 comprises SEQ ID NO: 10018, the LCDR2 comprises SEQ ID NO: 10021, and the LCDR3 comprises SEQ ID NO: 10024.

58. The antibody or antigen-binding fragment of embodiment 1, provided that the HFR1 comprises SEQ ID NO: 100108, the HFR2 comprises SEQ ID NO: 100101, the HFR3 comprises SEQ ID NO: 100109, the HFR4 comprises SEQ ID NO: 100103, the LFR1 comprises SEQ ID NO: 100104, the LFR2 comprises SEQ ID NO: 100105, the LFR3 comprises SEQ ID NO: 100110, the LFR4 comprises SEQ ID NO: 100107, the HCDR1 comprises SEQ ID NO: 100150, the HCDR2 comprises SEQ ID NO: 10012, the HCDR3 comprises SEQ ID NO: 100152, the LCDR1 comprises SEQ ID NO: 10018, the LCDR2 comprises SEQ ID NO: 10021, and the LCDR3 comprises SEQ ID NO: 100155.

59. The antibody or antigen-binding fragment of embodiment 1, provided that the HFR1 comprises SEQ ID NO: 100108, the HFR2 comprises SEQ ID NO: 100101, the HFR3 comprises SEQ ID NO: 100109, the HFR4 comprises SEQ ID NO: 100103, the LFR1 comprises SEQ ID NO: 100104, the LFR2 comprises SEQ ID NO: 100105, the LFR3 comprises SEQ ID NO: 100106, the LFR4 comprises SEQ ID NO: 100107, the HCDR1 comprises SEQ ID NO: 1009, the HCDR2 comprises SEQ ID NO: 10012, the HCDR3 comprises SEQ ID NO: 10015, the LCDR1 comprises SEQ ID NO: 10018, the LCDR2 comprises SEQ ID NO: 10021, and the LCDR3 comprises SEQ ID NO: 10024.

60. The antibody or antigen-binding fragment of embodiment 1, provided that the HFR1 comprises SEQ ID NO: 100108, the HFR2 comprises SEQ ID NO: 100101, the HFR3 comprises SEQ ID NO: 100109, the HFR4 comprises SEQ ID NO: 100103, the LFR1 comprises SEQ ID NO: 100104, the LFR2 comprises SEQ ID NO: 100105, the LFR3 comprises SEQ ID NO: 100106, the LFR4 comprises SEQ ID NO: 100107, the HCDR1 comprises SEQ ID NO: 100150, the HCDR2 comprises SEQ ID NO: 10012, the HCDR3 comprises SEQ ID NO: 100152, the LCDR1 comprises SEQ ID NO: 10018, the LCDR2 comprises SEQ ID NO: 10021, and the LCDR3 comprises SEQ ID NO: 100155.

61. The antibody or antigen-binding fragment of any of embodiments 1, 54, 56, 58, and 60, provided that the $X_1$ of SEQ ID NO: 100150 is D.

62. The antibody or antigen-binding fragment of any of embodiments 1, 54, 56, 58, and 60, provided that the $X_1$ of SEQ ID NO: 100150 is E.

63. The antibody or antigen-binding fragment of any of embodiments 1, 54, 56, 58, and 60-62, provided that the $X_2$ of SEQ ID NO: 100150 is I.

64. The antibody or antigen-binding fragment of any of embodiments 1, 54, 56, 58, and 60-62, provided that the $X_2$ of SEQ ID NO: 100150 is P.

65. The antibody or antigen-binding fragment of any of embodiments 1, 54, 56, 58, and 60-62, provided that the $X_2$ of SEQ ID NO: 100150 is V.

66. The antibody or antigen-binding fragment of any of embodiments 1, 54, 56, 58, and 60-65, provided that the $X_3$ of SEQ ID NO: 100150 is G.

67. The antibody or antigen-binding fragment of any of embodiments 1, 54, 56, 58, and 60-65, provided that the $X_3$ of SEQ ID NO: 100150 is Q.

68. The antibody or antigen-binding fragment of any of embodiments 1, 54, 56, 58, and 60-65, provided that the $X_3$ of SEQ ID NO: 100150 is S.

69. The antibody or antigen-binding fragment of any of embodiments 1, 54, 56, 58, and 60-65, provided that the $X_3$ of SEQ ID NO: 100150 is V.

70. The antibody or antigen-binding fragment of any of embodiments 1, 54, 56, 58, and 60-69, provided that the $X_4$ of SEQ ID NO: 100150 is F.

71. The antibody or antigen-binding fragment of any of embodiments 1, 54, 56, 58, and 60-69, provided that the $X_4$ of SEQ ID NO: 100150 is Y.

72. The antibody or antigen-binding fragment of any of embodiments 1, 54, 56, 58, and 60-71, provided that the $X_5$ of SEQ ID NO: 100150 is I.

73. The antibody or antigen-binding fragment of any of embodiments 1, 54, 56, 58, and 60-71, provided that the $X_5$ of SEQ ID NO: 100150 is M.

74. The antibody or antigen-binding fragment of any of embodiments 1, 54, 56, 58, and 60-73, provided that the $X_1$ of SEQ ID NO: 100152 is L.

75. The antibody or antigen-binding fragment of any of embodiments 1, 54, 56, 58, and 60-73, provided that the $X_1$ of SEQ ID NO: 100152 is M.

76. The antibody or antigen-binding fragment of any of embodiments 1, 54, 56, 58, and 60-75, provided that the $X_2$ of SEQ ID NO: 100152 is E.

77. The antibody or antigen-binding fragment of any of embodiments 1, 54, 56, 58, and 60-75, provided that the $X_2$ of SEQ ID NO: 100152 is I.

78. The antibody or antigen-binding fragment of any of embodiments 1, 54, 56, 58, and 60-75, provided that the $X_2$ of SEQ ID NO: 100152 is K.

79. The antibody or antigen-binding fragment of any of embodiments 1, 54, 56, 58, and 60-75, provided that the $X_2$ of SEQ ID NO: 100152 is L.

80. The antibody or antigen-binding fragment of any of embodiments 1, 54, 56, 58, and 60-75, provided that the $X_2$ of SEQ ID NO: 100152 is M.

81. The antibody or antigen-binding fragment of any of embodiments 1, 54, 56, 58, and 60-75, provided that the $X_2$ of SEQ ID NO: 100152 is Q.

82. The antibody or antigen-binding fragment of any of embodiments 1, 54, 56, 58, and 60-75, provided that the $X_2$ of SEQ ID NO: 100152 is T.

83. The antibody or antigen-binding fragment of any of embodiments 1, 54, 56, 58, and 60-75, provided that the $X_2$ of SEQ ID NO: 100152 is V.

84. The antibody or antigen-binding fragment of any of embodiments 1, 54, 56, 58, and 60-75, provided that the $X_2$ of SEQ ID NO: 100152 is W.

85. The antibody or antigen-binding fragment of any of embodiments 1, 54, 56, 58, and 60-75, provided that the $X_2$ of SEQ ID NO: 100152 is Y.

86. The antibody or antigen-binding fragment of any of embodiments 1, 54, 56, 58, and 60-85, provided that the $X_1$ of SEQ ID NO: 100155 is Q.
87. The antibody or antigen-binding fragment of any of embodiments 1, 54, 56, 58, and 60-85, provided that the $X_1$ of SEQ ID NO: 100155 is N.
88. The antibody or antigen-binding fragment of any of embodiments 1, 54, 56, 58, and 60-87, provided that the $X_2$ of SEQ ID NO: 100155 is D.
89. The antibody or antigen-binding fragment of any of embodiments 1, 54, 56, 58, and 60-87, provided that the $X_2$ of SEQ ID NO: 100155 is E.
90. The antibody or antigen-binding fragment of any of embodiments 1, 54, 56, 58, and 60-87, provided that the $X_2$ of SEQ ID NO: 100155 is H.
91. The antibody or antigen-binding fragment of any of embodiments 1, 54, 56, 58, and 60-87, provided that the $X_2$ of SEQ ID NO: 100155 is N.
92. The antibody or antigen-binding fragment of any of embodiments 1, 54, 56, 58, and 60-87, provided that the $X_2$ of SEQ ID NO: 100155 is Q.
93. The antibody or antigen-binding fragment of any of embodiments 1, 54, 56, 58, and 60-87, provided that the $X_2$ of SEQ ID NO: 100155 is S.
94. The antibody or antigen-binding fragment of any of embodiments 1, 54, 56, 58, and 60-93, provided that the $X_3$ of SEQ ID NO: 100155 is A.
95. The antibody or antigen-binding fragment of any of embodiments 1, 54, 56, 58, and 60-93, provided that the $X_3$ of SEQ ID NO: 100155 is G.
96. The antibody or antigen-binding fragment of any of embodiments 1, 54, 56, 58, and 60-95, provided that the $X_4$ of SEQ ID NO: 100155 is D.
97. The antibody or antigen-binding fragment of any of embodiments 1, 54, 56, 58, and 60-95, provided that the $X_4$ of SEQ ID NO: 100155 is F.
98. The antibody or antigen-binding fragment of any of embodiments 1, 54, 56, 58, and 60-95, provided that the $X_4$ of SEQ ID NO: 100155 is K.
99. The antibody or antigen-binding fragment of any of embodiments 1, 54, 56, 58, and 60-95, provided that the $X_4$ of SEQ ID NO: 100155 is N.
100. The antibody or antigen-binding fragment of any of embodiments 1, 54, 56, 58, and 60-95, provided that the $X_4$ of SEQ ID NO: 100155 is R.
101. The antibody or antigen-binding fragment of any of embodiments 1, 54, 56, 58, and 60-95, provided that the $X_4$ of SEQ ID NO: 100155 is S.
102. The antibody or antigen-binding fragment of any of embodiments 1, 54, 56, 58, and 60-95, provided that the $X_4$ of SEQ ID NO: 100155 is T.
103. The antibody or antigen-binding fragment of any of embodiments 1-102, provided that the antibody or antigen-binding fragment specifically binds to human TLA.
104. The antibody or antigen-binding fragment of embodiment 103, provided that the antibody or antigen-binding fragment specifically binds to human TL1A with a $K_d$ of $1\times10^{-9}$ M or less.
105. The antibody or antigen-binding fragment of embodiment 104, provided that the $K_d$ is measured using a method selected from a standard ELISA assay and SPR.
106. The antibody or antigen-binding fragment of any of embodiments 1-105, provided that the antibody or antigen-binding fragment inhibits binding of DR3 to human TLA.
107. The antibody or antigen-binding fragment of any of embodiments 1-106, provided that the antibody or antigen-binding fragment inhibits binding of DcR3 to human TL1A.
108. The antibody or antigen-binding fragment of any of embodiments 1-107, provided that the antibody or antigen-binding fragment is a humanized antibody, a CDR-grafted antibody, a chimeric antibody, a Fab, a ScFv, or a combination thereof.
109. The antibody or antigen-binding fragment of any of embodiments 1-108, comprising a human CH1 domain.
110. The antibody or antigen-binding fragment of any of embodiments 1-109, comprising a human CH2 domain.
111. The antibody or antigen-binding fragment of embodiment 110, provided that that CH2 domain comprises at least one mutation selected from L234A, L235A, and G237A, as numbered using Kabat.
112. The antibody or antigen-binding fragment of any of embodiments 1-111, comprising a human CH3 domain.
113. A pharmaceutical composition comprising a therapeutically effective amount of the antibody or antigen-binding fragment of any of embodiments 1-112, and a pharmaceutically acceptable carrier.
114. A method of treating an inflammatory disease in a subject in need thereof, comprising administering to the subject a therapeutically effective amount of the antibody or antigen-binding fragment of any of embodiments 1-113.
115. The method of embodiment 114, provided that the inflammatory disease is inflammatory bowel disease.
116. The method of embodiment 115, provided that the inflammatory bowel disease comprises Crohn's disease.
117. The method of embodiment 116, provided that the subject has been determined to be non-responsive to anti-TNF alpha therapy.
118. The method of embodiment 116 or embodiment 117, provided that the subject has been determined to comprise a disease phenotype comprising non-stricturing/non-penetrating, stricturing, stricturing and penetrating, or isolated internal penetrating.
119. An antibody or antigen-binding fragment that specifically binds to TL1A, comprising:
a heavy chain variable region comprising four heavy chain framework regions (HFR1, HFR2, HFR3, and HFR4) comprising SEQ ID NOS: 100100-100103, and three heavy chain complementarity-determining regions (HCDR1, HCDR2, and HCDR3) comprising:
(a) a HCDR1 selected from: (i) a HCDR1 comprising SEQ ID NO: 1009, (ii) a HCDR1 comprising SEQ ID NO: 100150, wherein $X_1$ is selected from D and E, $X_2$ is selected from I, P and V, $X_3$ is selected from G, Q, S, and V, $X_4$ is selected from F and Y, and $X_5$ is selected from I and M, (iii) a HCDR1 selected from SEQ ID NOS: 100200-100295, and (iv) a HCDR1 comprising an amino acid sequence that differs from a sequence selected from the group consisting of SEQ ID NOS: 1009, 100150 and 100200-100295 by up to five, four, three, or two amino acids,
(b) a HCDR2 selected from: (i) a HCDR2 comprising SEQ ID NO: 10012, and (ii) a HCDR2 comprising an amino acid sequence that differs from SEQ ID NO: 10012 by up to five, four, three, or two amino acids, and
(c) a HCDR3 selected from (i) a HCDR3 comprising SEQ ID NO: 10015, (ii) a HCDR3 comprising SEQ ID NO: 100152, wherein $X_1$ is selected from L and M, and $X_2$ is selected from E, I, K, L, M, Q, T, V, W, and Y, (iii)

a HCDR3 selected from SEQ ID NOS: 100296-100314, and (iv) a HCDR3 comprising an amino acid sequence that differs from a sequence selected from the group consisting of SEQ ID NOS: 10015, 100152 and 100296-100314 by up to five, four, three, or two amino acids; and a light chain variable region comprising four light chain framework regions (LFR1, LFR2, LFR3, and LFR4) comprising SEQ ID NOS: 100104-100107, and three light chain complementarity-determining regions (LCDR1, LCDR2, and LCDR3) comprising:

- (a) a LCDR1 selected from: (i) a LCDR1 comprising SEQ ID NO: 10018, and (ii) a LCDR1 comprising an amino acid sequence that differs from SEQ ID NO: 10018 by up to five, four, three, or two amino acids,
- (b) a LCDR2 selected from: (i) a LCDR2 comprising SEQ ID NO: 10021, and (ii) a LCDR2 comprising an amino acid sequence that differs from SEQ ID NO: 10021 by up to five, four, three, or two amino acids, and
- (c) a LCDR3 selected from (i) a LCDR3 comprising SEQ ID NO: 10024, (ii) a LCDR3 comprising SEQ ID NO: 100155, wherein $X_1$ is selected from Q and N, $X_2$ is selected from D, E, H, N, Q, and S, $X_3$ is selected from A and G, and $X_4$ is selected from D, F, K, N, R, S, and T, (iii) a LCDR3 selected from SEQ ID NOS: 100315-100482, and (iv) a LCDR3 comprising an amino acid sequence that differs from a sequence selected from the group consisting of SEQ ID NOS: 10024, 100155, and 100315-100482 by up to five, four, three, or two amino acids.

120. The antibody or antigen-binding fragment of embodiment 119, provided that the HCDR1 comprises SEQ ID NO: 1009.

121. The antibody or antigen-binding fragment of embodiment 119, provided that the HCDR1 comprises SEQ ID NO: 100150.

122. The antibody or antigen-binding fragment of embodiment 121, provided that $X_1$ is E.

123. The antibody or antigen-binding fragment of embodiment 121 or embodiment 122, provided that $X_2$ is selected from P and V.

124. The antibody or antigen-binding fragment of any of embodiments 121-123, provided that $X_3$ is selected from G, S, and V.

125. The antibody or antigen-binding fragment of any of embodiments 121-124, provided that $X_4$ is F.

126. The antibody or antigen-binding fragment of any of embodiments 121-125, provided that $X_5$ is I.

127. The antibody or antigen-binding fragment of embodiment 119, provided that the HCDR1 comprises an amino acid sequence selected from SEQ ID NOS: 100200-100295.

128. The antibody or antigen-binding fragment of any of embodiments 119-127, provided that the HCDR2 comprises SEQ ID NO: 10012.

129. The antibody or antigen-binding fragment of any of embodiments 119-127, provided that the HCDR2 comprises an amino acid sequence that differs from SEQ ID NO: 10012 by up to five, four, three, or two amino acids.

130. The antibody or antigen-binding fragment of any of embodiments 119-129, provided that the HCDR3 comprises SEQ ID NO: 10015.

131. The antibody or antigen-binding fragment of any of embodiments 119-129, provided that the HCDR3 comprises SEQ ID NO: 100152.

132. The antibody or antigen-binding fragment of embodiment 131, provided that $X_1$ is M.

133. The antibody or antigen-binding fragment of embodiment 131 or embodiment 132, provided that $X_2$ is selected from E, I, K, L, M, Q, T, W, and Y.

134. The antibody or antigen-binding fragment of any of embodiments 119-129, provided that the HCDR3 comprises a sequence selected from SEQ ID NOS: 100296-100314.

135. The antibody or antigen-binding fragment of any of embodiments 119-134, provided that the LCDR1 comprises SEQ ID NO: 10018.

136. The antibody or antigen-binding fragment of any of embodiments 119-134, provided that the LCDR1 comprises an amino acid sequence that differs from SEQ ID NO: 10018 by up to five, four, three, or two amino acids.

137. The antibody or antigen-binding fragment of any of embodiments 119-136, provided that the LCDR2 comprises SEQ ID NO: 10021.

138. The antibody or antigen-binding fragment of any of embodiments 119-136, provided that the LCDR2 comprises an amino acid sequence that differs from SEQ ID NO: 10021 by up to five, four, three, or two amino acids.

139. The antibody or antigen-binding fragment of any of embodiments 119-138, provided that the LCDR3 comprises SEQ ID NO: 10024.

140. The antibody or antigen-binding fragment of any of embodiments 119-138, provided that the LCDR3 comprises SEQ ID NO: 100155.

141. The antibody or antigen-binding fragment of embodiment 140, provided that $X_1$ is N.

142. The antibody or antigen-binding fragment of embodiment 140 or embodiment 141, provided that $X_2$ is selected from D, E, H, N, and Q.

143. The antibody or antigen-binding fragment of any of embodiments 140-142, provided that $X_3$ is A.

144. The antibody or antigen-binding fragment of any of embodiments 140-143, provided that $X_4$ is selected from D, F, K, R, S, and T.

145. The antibody or antigen-binding fragment of any of embodiments 119-138, provided that the LCDR3 comprises an amino acid sequence selected from SEQ ID NOS: 100315-100482.

146. The antibody or antigen-binding fragment of embodiment 119, provided that the HCDR1 comprises SEQ ID NO: 1009, the HCDR2 comprises SEQ ID NO: 10012, the HCDR3 comprises SEQ ID NO: 10015, the LCDR1 comprises SEQ ID NO: 10018, the LCDR2 comprises SEQ ID NO: 10021, and the LCDR3 comprises SEQ ID NO: 10024.

147. The antibody or antigen-binding fragment of embodiment 119, provided that the HCDR1 comprises SEQ ID NO: 100150, the HCDR2 comprises SEQ ID NO: 10012, the HCDR3 comprises SEQ ID NO: 100152, the LCDR1 comprises SEQ ID NO: 10018, the LCDR2 comprises SEQ ID NO: 10021, and the LCDR3 comprises SEQ ID NO: 100155.

148. The antibody or antigen-binding fragment of embodiment 119 or embodiment 147, provided that the $X_1$ of SEQ ID NO: 100150 is D.

149. The antibody or antigen-binding fragment of embodiment 119 or embodiment 147 provided that the $X_1$ of SEQ ID NO: 100150 is E.

150. The antibody or antigen-binding fragment of any of embodiments 119, 147-149, provided that the $X_2$ of SEQ ID NO: 100150 is I.
151. The antibody or antigen-binding fragment of any of embodiments 119, 147-149, provided that the $X_2$ of SEQ ID NO: 100150 is P.
152. The antibody or antigen-binding fragment of any of embodiments 119, 147-149, provided that the $X_2$ of SEQ ID NO: 100150 is V.
153. The antibody or antigen-binding fragment of any of embodiments 119, 147-152, provided that the $X_3$ of SEQ ID NO: 100150 is G.
154. The antibody or antigen-binding fragment of any of embodiments 119, 147-152, provided that the $X_3$ of SEQ ID NO: 100150 is Q.
155. The antibody or antigen-binding fragment of any of embodiments 119, 147-152, provided that the $X_3$ of SEQ ID NO: 100150 is S.
156. The antibody or antigen-binding fragment of any of embodiments 119, 147-152, provided that the $X_3$ of SEQ ID NO: 100150 is V.
157. The antibody or antigen-binding fragment of any of embodiments 119, 147-156, provided that the $X_4$ of SEQ ID NO: 100150 is F.
158. The antibody or antigen-binding fragment of any of embodiments 119, 147-156, provided that the $X_4$ of SEQ ID NO: 100150 is Y.
159. The antibody or antigen-binding fragment of any of embodiments 119, 147-158, provided that the $X_5$ of SEQ ID NO: 100150 is I.
160. The antibody or antigen-binding fragment of any of embodiments 119, 147-158, provided that the $X_5$ of SEQ ID NO: 100150 is M.
161. The antibody or antigen-binding fragment of any of embodiments 119, 147-160, provided that the $X_1$ of SEQ ID NO: 100152 is L.
162. The antibody or antigen-binding fragment of any of embodiments 119, 147-160, provided that the $X_1$ of SEQ ID NO: 100152 is M.
163. The antibody or antigen-binding fragment of any of embodiments 119, 147-162, provided that the $X_2$ of SEQ ID NO: 100152 is E.
164. The antibody or antigen-binding fragment of any of embodiments 119, 147-162, provided that the $X_2$ of SEQ ID NO: 100152 is I.
165. The antibody or antigen-binding fragment of any of embodiments 119, 147-162, provided that the $X_2$ of SEQ ID NO: 100152 is K.
166. The antibody or antigen-binding fragment of any of embodiments 119, 147-162, provided that the $X_2$ of SEQ ID NO: 100152 is L.
167. The antibody or antigen-binding fragment of any of embodiments 119, 147-162, provided that the $X_2$ of SEQ ID NO: 100152 is M.
168. The antibody or antigen-binding fragment of any of embodiments 119, 147-162, provided that the $X_2$ of SEQ ID NO: 100152 is Q.
169. The antibody or antigen-binding fragment of any of embodiments 119, 147-162, provided that the $X_2$ of SEQ ID NO: 100152 is T.
170. The antibody or antigen-binding fragment of any of embodiments 119, 147-162, provided that the $X_2$ of SEQ ID NO: 100152 is V.
171. The antibody or antigen-binding fragment of any of embodiments 119, 147-162, provided that the $X_2$ of SEQ ID NO: 100152 is W.
172. The antibody or antigen-binding fragment of any of embodiments 119, 147-162, provided that the $X_2$ of SEQ ID NO: 100152 is Y.
173. The antibody or antigen-binding fragment of any of embodiments 119, 147-172, provided that the $X_1$ of SEQ ID NO: 100155 is Q.
174. The antibody or antigen-binding fragment of any of embodiments 119, 147-172, provided that the $X_1$ of SEQ ID NO: 100155 is N.
175. The antibody or antigen-binding fragment of any of embodiments 119, 147-174, provided that the $X_2$ of SEQ ID NO: 100155 is D.
176. The antibody or antigen-binding fragment of any of embodiments 119, 147-174, provided that the $X_2$ of SEQ ID NO: 100155 is E.
177. The antibody or antigen-binding fragment of any of embodiments 119, 147-174, provided that the $X_2$ of SEQ ID NO: 100155 is H.
178. The antibody or antigen-binding fragment of any of embodiments 119, 147-174, provided that the $X_2$ of SEQ ID NO: 100155 is N.
179. The antibody or antigen-binding fragment of any of embodiments 119, 147-174, provided that the $X_2$ of SEQ ID NO: 100155 is Q.
180. The antibody or antigen-binding fragment of any of embodiments 119, 147-174, provided that the $X_2$ of SEQ ID NO: 100155 is S.
181. The antibody or antigen-binding fragment of any of embodiments 119, 147-180, provided that the $X_3$ of SEQ ID NO: 100155 is A.
182. The antibody or antigen-binding fragment of any of embodiments 119, 147-180, provided that the $X_3$ of SEQ ID NO: 100155 is G.
183. The antibody or antigen-binding fragment of any of embodiments 119, 147-182, provided that the $X_4$ of SEQ ID NO: 100155 is D.
184. The antibody or antigen-binding fragment of any of embodiments 119, 147-182, provided that the $X_4$ of SEQ ID NO: 100155 is F.
185. The antibody or antigen-binding fragment of any of embodiments 119, 147-182, provided that the $X_4$ of SEQ ID NO: 100155 is K.
186. The antibody or antigen-binding fragment of any of embodiments 119, 147-182, provided that the $X_4$ of SEQ ID NO: 100155 is N.
187. The antibody or antigen-binding fragment of any of embodiments 119, 147-182, provided that the $X_4$ of SEQ ID NO: 100155 is R.
188. The antibody or antigen-binding fragment of any of embodiments 119, 147-182, provided that the $X_4$ of SEQ ID NO: 100155 is S.
189. The antibody or antigen-binding fragment of any of embodiments 119, 147-182, provided that the $X_4$ of SEQ ID NO: 100155 is T.
190. The antibody or antigen-binding fragment of any of embodiments 119-189, provided that the antibody or antigen-binding fragment specifically binds to human TLA.
191. The antibody or antigen-binding fragment of embodiment 190, provided that the antibody or antigen-binding fragment specifically binds to human TL1A with a $K_d$ of $1 \times 10^{-9}$ M or less.
192. The antibody or antigen-binding fragment of embodiment 191, provided that the $K_d$ is measured using a method selected from a standard ELISA assay and SPR.

193. The antibody or antigen-binding fragment of any of embodiments 119-192, provided that the antibody or antigen-binding fragment inhibits binding of DR3 to human TLA.
194. The antibody or antigen-binding fragment of any of embodiments 119-193, provided that the antibody or antigen-binding fragment inhibits binding of DcR3 to human TL1A.
195. The antibody or antigen-binding fragment of any of embodiments 119-194, provided that the antibody or antigen-binding fragment is a humanized antibody, a CDR-grafted antibody, a chimeric antibody, a Fab, a ScFv, or a combination thereof.
196. The antibody or antigen-binding fragment of any of embodiments 119-195, comprising a human CH1 domain.
197. The antibody or antigen-binding fragment of any of embodiments 119-196, comprising a human CH2 domain.
198. The antibody or antigen-binding fragment of embodiment 197, provided that that CH2 domain comprises at least one mutation selected from L234A, L235A, and G237A, as numbered using Kabat.
199. The antibody or antigen-binding fragment of any of embodiments 119-198, comprising a human CH3 domain.
200. A pharmaceutical composition comprising a therapeutically effective amount of the antibody or antigen-binding fragment of any of embodiments 119-199, and a pharmaceutically acceptable carrier.
201. A method of treating an inflammatory disease in a subject in need thereof, comprising administering to the subject a therapeutically effective amount of the antibody or antigen-binding fragment of any of embodiments 119-199.
202. The method of embodiment 201, provided that the inflammatory disease is inflammatory bowel disease.
203. The method of embodiment 202, provided that the inflammatory bowel disease comprises Crohn's disease.
204. The method of embodiment 203, provided that the subject has been determined to be non-responsive to anti-TNFalpha therapy.
205. The method of embodiment 203 or embodiment 204, provided that the subject has been determined to comprise a disease phenotype comprising non-stricturing/non-penetrating, stricturing, stricturing and penetrating, or isolated internal penetrating.
206. An antibody or antigen-binding fragment that specifically binds to TLA, comprising:
a heavy chain variable region comprising four heavy chain framework regions (HFR1, HFR2, HFR3, and HFR4) comprising SEQ ID NOS: 100108, 100101, 100109, and 100103, respectively, and three heavy chain complementarity-determining regions (HCDR1, HCDR2, and HCDR3) comprising:
  (a) a HCDR1 selected from: (i) a HCDR1 comprising SEQ ID NO: 1009, (ii) a HCDR1 comprising SEQ ID NO: 100150, wherein $X_1$ is selected from D and E, $X_2$ is selected from I, P and V, $X_3$ is selected from G, Q, S, and V, $X_4$ is selected from F and Y, and $X_5$ is selected from I and M, (iii) a HCDR1 selected from SEQ ID NOS: 100200-100295, and (iv) a HCDR1 comprising an amino acid sequence that differs from a sequence selected from the group consisting of SEQ ID NOS: 1009, 100150 and 100200-100295 by up to five, four, three, or two amino acids,
  (b) a HCDR2 selected from: (i) a HCDR2 comprising SEQ ID NO: 10012, and (ii) a HCDR2 comprising an amino acid sequence that differs from SEQ ID NO: 10012 by up to five, four, three, or two amino acids, and
  (c) a HCDR3 selected from (i) a HCDR3 comprising SEQ ID NO: 10015, (ii) a HCDR3 comprising SEQ ID NO: 100152, wherein $X_1$ is selected from L and M, and $X_2$ is selected from E, I, K, L, M, Q, T, V, W, and Y, (iii) a HCDR3 selected from SEQ ID NOS: 100296-100314, and (iv) a HCDR3 comprising an amino acid sequence that differs from a sequence selected from the group consisting of SEQ ID NOS: 10015, 100152 and 100296-100314 by up to five, four, three, or two amino acids; and
a light chain variable region comprising four light chain framework regions (LFR1, LFR2, LFR3, and LFR4) comprising SEQ ID NOS: 100104, 100105, 100110, and 100107, respectively, and three light chain complementarity-determining regions (LCDR1, LCDR2, and LCDR3) comprising:
  (a) a LCDR1 selected from: (i) a LCDR1 comprising SEQ ID NO: 10018, and (ii) a LCDR1 comprising an amino acid sequence that differs from SEQ ID NO: 10018 by up to five, four, three, or two amino acids,
  (b) a LCDR2 selected from: (i) a LCDR2 comprising SEQ ID NO: 10021, and (ii) a LCDR2 comprising an amino acid sequence that differs from SEQ ID NO: 10021 by up to five, four, three, or two amino acids, and
  (c) a LCDR3 selected from (i) a LCDR3 comprising SEQ ID NO: 10024, (ii) a LCDR3 comprising SEQ ID NO: 100155, wherein $X_1$ is selected from Q and N, $X_2$ is selected from D, E, H, N, Q, and S, $X_3$ is selected from A and G, and $X_4$ is selected from D, F, K, N, R, S, and T, (iii) a LCDR3 selected from SEQ ID NOS: 100315-100482, and (iv) a LCDR3 comprising an amino acid sequence that differs from a sequence selected from the group consisting of SEQ ID NOS: 10024, 100155, and 100315-100482 by up to five, four, three, or two amino acids.
207. The antibody or antigen-binding fragment of embodiment 206, provided that the HCDR1 comprises SEQ ID NO: 1009.
208. The antibody or antigen-binding fragment of embodiment 206, provided that the HCDR1 comprises SEQ ID NO: 100150.
209. The antibody or antigen-binding fragment of embodiment 208, provided that $X_1$ is E.
210. The antibody or antigen-binding fragment of embodiment 208 or embodiment 209, provided that $X_2$ is selected from P and V.
211. The antibody or antigen-binding fragment of any of embodiments 208-210, provided that $X_3$ is selected from G, S, and V.
212. The antibody or antigen-binding fragment of any of embodiments 208-211, provided that $X_4$ is F.
213. The antibody or antigen-binding fragment of any of embodiments 208-212, provided that $X_5$ is I.
214. The antibody or antigen-binding fragment of embodiment 206, provided that the HCDR1 comprises an amino acid sequence selected from SEQ ID NOS: 100200-100295.
215. The antibody or antigen-binding fragment of any of embodiments 206-214, provided that the HCDR2 comprises SEQ ID NO: 10012.
216. The antibody or antigen-binding fragment of any of embodiments 206-214, provided that the HCDR2 comprises an amino acid sequence that differs from SEQ ID NO: 10012 by up to five, four, three, or two amino acids.
217. The antibody or antigen-binding fragment of any of embodiments 206-216, provided that the HCDR3 comprises SEQ ID NO: 10015.
218. The antibody or antigen-binding fragment of any of embodiments 206-216, provided that the HCDR3 comprises SEQ ID NO: 100152.
219. The antibody or antigen-binding fragment of embodiment 218, provided that $X_1$ is M.
220. The antibody or antigen-binding fragment of embodiment 218 or embodiment 219, provided that $X_2$ is selected from E, I, K, L, M, Q, T, W, and Y.
221. The antibody or antigen-binding fragment of any of embodiments 206-220, provided that the HCDR3 comprises a sequence selected from SEQ ID NOS: 100296-100314.
222. The antibody or antigen-binding fragment of any of embodiments 206-221, provided that the LCDR1 comprises SEQ ID NO: 10018.
223. The antibody or antigen-binding fragment of any of embodiments 206-221, provided that the LCDR1 comprises an amino acid sequence that differs from SEQ ID NO: 10018 by up to five, four, three, or two amino acids.
224. The antibody or antigen-binding fragment of any of embodiments 206-223, provided that the LCDR2 comprises SEQ ID NO: 10021.
225. The antibody or antigen-binding fragment of any of embodiments 206-223, provided that the LCDR2 comprises an amino acid sequence that differs from SEQ ID NO: 10021 by up to five, four, three, or two amino acids.
226. The antibody or antigen-binding fragment of any of embodiments 206-225, provided that the LCDR3 comprises SEQ ID NO: 10024.
227. The antibody or antigen-binding fragment of any of embodiments 206-225, provided that the LCDR3 comprises SEQ ID NO: 100155.
228. The antibody or antigen-binding fragment of embodiment 227, provided that $X_1$ is N.
229. The antibody or antigen-binding fragment of embodiment 227 or embodiment 228, provided that $X_2$ is selected from D, E, H, N, and Q.
230. The antibody or antigen-binding fragment of any of embodiments 227-229, provided that $X_3$ is A.
231. The antibody or antigen-binding fragment of any of embodiments 227-230, provided that $X_4$ is selected from D, F, K, R, S, and T.
232. The antibody or antigen-binding fragment of any of embodiments 227-231, provided that the LCDR3 comprises an amino acid sequence selected from SEQ ID NOS: 100315-100482.
233. The antibody or antigen-binding fragment of embodiment 206, provided that the HCDR1 comprises SEQ ID NO: 1009, the HCDR2 comprises SEQ ID NO: 10012, the HCDR3 comprises SEQ ID NO: 10015, the LCDR1 comprises SEQ ID NO: 10018, the LCDR2 comprises SEQ ID NO: 10021, and the LCDR3 comprises SEQ ID NO: 10024.
234. The antibody or antigen-binding fragment of embodiment 206, provided that the HCDR1 comprises SEQ ID NO: 100150, the HCDR2 comprises SEQ ID NO: 10012, the HCDR3 comprises SEQ ID NO: 100152, the LCDR1 comprises SEQ ID NO: 10018, the LCDR2 comprises SEQ ID NO: 10021, and the LCDR3 comprises SEQ ID NO: 100155.
235. The antibody or antigen-binding fragment of embodiment 206 or embodiment 234, provided that the $X_1$ of SEQ ID NO: 100150 is D.
236. The antibody or antigen-binding fragment of embodiment 206 or embodiment 234 provided that the $X_1$ of SEQ ID NO: 100150 is E.
237. The antibody or antigen-binding fragment of any of embodiments 206, 234-236, provided that the $X_2$ of SEQ ID NO: 100150 is I.
238. The antibody or antigen-binding fragment of any of embodiments 206, 234-236, provided that the $X_2$ of SEQ ID NO: 100150 is P.
239. The antibody or antigen-binding fragment of any of embodiments 206, 234-236, provided that the $X_2$ of SEQ ID NO: 100150 is V.
240. The antibody or antigen-binding fragment of any of embodiments 206, 234-239, provided that the $X_3$ of SEQ ID NO: 100150 is G.
241. The antibody or antigen-binding fragment of any of embodiments 206, 234-239, provided that the $X_3$ of SEQ ID NO: 100150 is Q.
242. The antibody or antigen-binding fragment of any of embodiments 206, 234-239, provided that the $X_3$ of SEQ ID NO: 100150 is S.
243. The antibody or antigen-binding fragment of any of embodiments 206, 234-239, provided that the $X_3$ of SEQ ID NO: 100150 is V.
244. The antibody or antigen-binding fragment of any of embodiments 206, 234-243, provided that the $X_4$ of SEQ ID NO: 100150 is F.
245. The antibody or antigen-binding fragment of any of embodiments 206, 234-243, provided that the $X_4$ of SEQ ID NO: 100150 is Y.
246. The antibody or antigen-binding fragment of any of embodiments 206, 234-245, provided that the $X_5$ of SEQ ID NO: 100150 is I.
247. The antibody or antigen-binding fragment of any of embodiments 206, 234-245, provided that the $X_5$ of SEQ ID NO: 100150 is M.
248. The antibody or antigen-binding fragment of any of embodiments 206, 234-247, provided that the $X_1$ of SEQ ID NO: 100152 is L.
249. The antibody or antigen-binding fragment of any of embodiments 206, 234-247, provided that the $X_1$ of SEQ ID NO: 100152 is M.
250. The antibody or antigen-binding fragment of any of embodiments 206, 234-249, provided that the $X_2$ of SEQ ID NO: 100152 is E.
251. The antibody or antigen-binding fragment of any of embodiments 206, 234-249, provided that the $X_2$ of SEQ ID NO: 100152 is I.
252. The antibody or antigen-binding fragment of any of embodiments 206, 234-249, provided that the $X_2$ of SEQ ID NO: 100152 is K.
253. The antibody or antigen-binding fragment of any of embodiments 206, 234-249, provided that the $X_2$ of SEQ ID NO: 100152 is L.
254. The antibody or antigen-binding fragment of any of embodiments 206, 234-249, provided that the $X_2$ of SEQ ID NO: 100152 is M.
255. The antibody or antigen-binding fragment of any of embodiments 206, 234-249, provided that the $X_2$ of SEQ ID NO: 100152 is Q.

256. The antibody or antigen-binding fragment of any of embodiments 206, 234-249, provided that the $X_2$ of SEQ ID NO: 100152 is T.
257. The antibody or antigen-binding fragment of any of embodiments 206, 234-249, provided that the $X_2$ of SEQ ID NO: 100152 is V.
258. The antibody or antigen-binding fragment of any of embodiments 206, 234-249, provided that the $X_2$ of SEQ ID NO: 100152 is W.
259. The antibody or antigen-binding fragment of any of embodiments 206, 234-249, provided that the $X_2$ of SEQ ID NO: 100152 is Y.
260. The antibody or antigen-binding fragment of any of embodiments 206, 234-259, provided that the $X_1$ of SEQ ID NO: 100155 is Q.
261. The antibody or antigen-binding fragment of any of embodiments 206, 234-259, provided that the $X_1$ of SEQ ID NO: 100155 is N.
262. The antibody or antigen-binding fragment of any of embodiments 206, 234-261, provided that the $X_2$ of SEQ ID NO: 100155 is D.
263. The antibody or antigen-binding fragment of any of embodiments 206, 234-261, provided that the $X_2$ of SEQ ID NO: 100155 is E.
264. The antibody or antigen-binding fragment of any of embodiments 206, 234-261, provided that the $X_2$ of SEQ ID NO: 100155 is H.
265. The antibody or antigen-binding fragment of any of embodiments 206, 234-261, provided that the $X_2$ of SEQ ID NO: 100155 is N.
266. The antibody or antigen-binding fragment of any of embodiments 206, 234-261, provided that the $X_2$ of SEQ ID NO: 100155 is Q.
267. The antibody or antigen-binding fragment of any of embodiments 206, 234-261, provided that the $X_2$ of SEQ ID NO: 100155 is S.
268. The antibody or antigen-binding fragment of any of embodiments 206, 234-267, provided that the $X_3$ of SEQ ID NO: 100155 is A.
269. The antibody or antigen-binding fragment of any of embodiments 206, 234-267, provided that the $X_3$ of SEQ ID NO: 100155 is G.
270. The antibody or antigen-binding fragment of any of embodiments 206, 234-269, provided that the $X_4$ of SEQ ID NO: 100155 is D.
271. The antibody or antigen-binding fragment of any of embodiments 206, 234-269, provided that the $X_4$ of SEQ ID NO: 100155 is F.
272. The antibody or antigen-binding fragment of any of embodiments 206, 234-269, provided that the $X_4$ of SEQ ID NO: 100155 is K.
273. The antibody or antigen-binding fragment of any of embodiments 206, 234-269, provided that the $X_4$ of SEQ ID NO: 100155 is N.
274. The antibody or antigen-binding fragment of any of embodiments 206, 234-269, provided that the $X_4$ of SEQ ID NO: 100155 is R.
275. The antibody or antigen-binding fragment of any of embodiments 206, 234-269, provided that the $X_4$ of SEQ ID NO: 100155 is S.
276. The antibody or antigen-binding fragment of any of embodiments 206, 234-269, provided that the $X_4$ of SEQ ID NO: 100155 is T.
277. The antibody or antigen-binding fragment of any of embodiments 206-276, provided that the antibody or antigen-binding fragment specifically binds to human TL1A.
278. The antibody or antigen-binding fragment of embodiment 277, provided that the antibody or antigen-binding fragment specifically binds to human TL1A with a $K_d$ of $1\times10^{-9}$ M or less.
279. The antibody or antigen-binding fragment of embodiment 278, provided that the $K_d$ is measured using a method selected from a standard ELISA assay and SPR.
280. The antibody or antigen-binding fragment of any of embodiments 206-279, provided that the antibody or antigen-binding fragment inhibits binding of DR3 to human TLA.
281. The antibody or antigen-binding fragment of any of embodiments 206-280, provided that the antibody or antigen-binding fragment inhibits binding of DcR3 to human TL1A.
282. The antibody or antigen-binding fragment of any of embodiments 206-281, provided that the antibody or antigen-binding fragment is a humanized antibody, a CDR-grafted antibody, a chimeric antibody, a Fab, a ScFv, or a combination thereof.
283. The antibody or antigen-binding fragment of any of embodiments 206-282, comprising a human CH1 domain.
284. The antibody or antigen-binding fragment of any of embodiments 206-283, comprising a human CH2 domain.
285. The antibody or antigen-binding fragment of embodiment 284, provided that that CH2 domain comprises at least one mutation selected from L234A, L235A, and G237A, as numbered using Kabat.
286. The antibody or antigen-binding fragment of any of embodiments 206-285, comprising a human CH3 domain.
287. A pharmaceutical composition comprising a therapeutically effective amount of the antibody or antigen-binding fragment of any of embodiments 206-286, and a pharmaceutically acceptable carrier.
288. A method of treating an inflammatory disease in a subject in need thereof, comprising administering to the subject a therapeutically effective amount of the antibody or antigen-binding fragment of any of embodiments 206-287.
289. The method of embodiment 288, provided that the inflammatory disease is inflammatory bowel disease.
290. The method of embodiment 289, provided that the inflammatory bowel disease comprises Crohn's disease.
291. The method of embodiment 290, provided that the subject has been determined to be non-responsive to anti-TNFalpha therapy.
292. The method of embodiment 290 or embodiment 291, provided that the subject has been determined to comprise a disease phenotype comprising non-stricturing/non-penetrating, stricturing, stricturing and penetrating, or isolated internal penetrating.
293. An antibody or antigen-binding fragment that specifically binds to TL1A, comprising:
a heavy chain variable region comprising four heavy chain framework regions (HFR1, HFR2, HFR3, and HFR4) comprising SEQ ID NOS: 100108, 100101, 100109, and 100103, respectively, and three heavy chain complementarity-determining regions (HCDR1, HCDR2, and HCDR3) comprising:
(a) a HCDR1 selected from: (i) a HCDR1 comprising SEQ ID NO: 1009, (ii) a HCDR1 comprising SEQ ID NO: 100150, wherein $X_1$ is selected from D and E, $X_2$ is selected from I, P and V, $X_3$ is selected from G, Q, S, and V, $X_4$ is selected from F and Y, and $X_5$ is selected from I and M, (iii) a HCDR1 selected from SEQ ID NOS: 100200-100295, and (iv) a HCDR1 comprising an amino acid sequence that differs from a sequence selected from the group consisting of SEQ ID NOS: 1009, 100150 and 100200-100295 by up to five, four, three, or two amino acids,
- (b) a HCDR2 selected from: (i) a HCDR2 comprising SEQ ID NO: 10012, and (ii) a HCDR2 comprising an amino acid sequence that differs from SEQ ID NO: 10012 by up to five, four, three, or two amino acids, and
- (c) a HCDR3 selected from (i) a HCDR3 comprising SEQ ID NO: 10015, (ii) a HCDR3 comprising SEQ ID NO: 100152, wherein $X_1$ is selected from L and M, and $X_2$ is selected from E, I, K, L, M, Q, T, V, W, and Y, (iii) a HCDR3 selected from SEQ ID NOS: 100296-100314, and (iv) a HCDR3 comprising an amino acid sequence that differs from a sequence selected from the group consisting of SEQ ID NOS: 10015, 100152 and 100296-100314 by up to five, four, three, or two amino acids; and a light chain variable region comprising four light chain framework regions (LFR1, LFR2, LFR3, and LFR4) comprising SEQ ID NOS: 100104-100107, and three light chain complementarity-determining regions (LCDR1, LCDR2, and LCDR3) comprising:
- (a) a LCDR1 selected from: (i) a LCDR1 comprising SEQ ID NO: 10018, and (ii) a LCDR1 comprising an amino acid sequence that differs from SEQ ID NO: 10018 by up to five, four, three, or two amino acids,
- (b) a LCDR2 selected from: (i) a LCDR2 comprising SEQ ID NO: 10021, and (ii) a LCDR2 comprising an amino acid sequence that differs from SEQ ID NO: 10021 by up to five, four, three, or two amino acids, and
- (c) a LCDR3 selected from (i) a LCDR3 comprising SEQ ID NO: 10024, (ii) a LCDR3 comprising SEQ ID NO: 100155, wherein $X_1$ is selected from Q and N, $X_2$ is selected from D, E, H, N, Q, and S, $X_3$ is selected from A and G, and $X_4$ is selected from D, F, K, N, R, S, and T, (iii) a LCDR3 selected from SEQ ID NOS: 100315-100482, and (iv) a LCDR3 comprising an amino acid sequence that differs from a sequence selected from the group consisting of SEQ ID NOS: 10024, 100155, and 100315-100482 by up to five, four, three, or two amino acids.

294. The antibody or antigen-binding fragment of embodiment 293, provided that the HCDR1 comprises SEQ ID NO: 1009.

295. The antibody or antigen-binding fragment of embodiment 293, provided that the HCDR1 comprises SEQ ID NO: 100150.

296. The antibody or antigen-binding fragment of embodiment 295, provided that $X_1$ is E.

297. The antibody or antigen-binding fragment of embodiment 295 or embodiment 296, provided that $X_2$ is selected from P and V.

298. The antibody or antigen-binding fragment of any of embodiments 295-297, provided that $X_3$ is selected from G, S, and V.

299. The antibody or antigen-binding fragment of any of embodiments 295-298, provided that $X_4$ is F.

300. The antibody or antigen-binding fragment of any of embodiments 295-299, provided that $X_5$ is I.

301. The antibody or antigen-binding fragment of embodiment 293, provided that the HCDR1 comprises an amino acid sequence selected from SEQ ID NOS: 100200-100295.

302. The antibody or antigen-binding fragment of any of embodiments 293-301, provided that the HCDR2 comprises SEQ ID NO: 10012.

303. The antibody or antigen-binding fragment of any of embodiments 293-301 provided that the HCDR2 comprises an amino acid sequence that differs from SEQ ID NO: 10012 by up to five, four, three, or two amino acids.

304. The antibody or antigen-binding fragment of any of embodiments 293-303, provided that the HCDR3 comprises SEQ ID NO: 10015.

305. The antibody or antigen-binding fragment of any of embodiments 293-303, provided that the HCDR3 comprises SEQ ID NO: 100152.

306. The antibody or antigen-binding fragment of embodiment 305, provided that $X_1$ is M.

307. The antibody or antigen-binding fragment of embodiment 305 or embodiment 306, provided that $X_2$ is selected from E, I, K, L, M, Q, T, W, and Y.

308. The antibody or antigen-binding fragment of any of embodiments 293-303, provided that the HCDR3 comprises a sequence selected from SEQ ID NOS: 100296-100314.

309. The antibody or antigen-binding fragment of any of embodiments 293-308, provided that the LCDR1 comprises SEQ ID NO: 10018.

310. The antibody or antigen-binding fragment of any of embodiments 293-308, provided that the LCDR1 comprises an amino acid sequence that differs from SEQ ID NO: 10018 by up to five, four, three, or two amino acids.

311. The antibody or antigen-binding fragment of any of embodiments 293-310, provided that the LCDR2 comprises SEQ ID NO: 10021.

312. The antibody or antigen-binding fragment of any of embodiments 293-310, provided that the LCDR2 comprises an amino acid sequence that differs from SEQ ID NO: 10021 by up to five, four, three, or two amino acids.

313. The antibody or antigen-binding fragment of any of embodiments 293-312, provided that the LCDR3 comprises SEQ ID NO: 10024.

314. The antibody or antigen-binding fragment of any of embodiments 293-312, provided that the LCDR3 comprises SEQ ID NO: 100155.

315. The antibody or antigen-binding fragment of embodiment 314, provided that $X_1$ is N.

316. The antibody or antigen-binding fragment of embodiment 314 or embodiment 315, provided that $X_2$ is selected from D, E, H, N, and Q.

317. The antibody or antigen-binding fragment of any of embodiments 314-316, provided that $X_3$ is A.

318. The antibody or antigen-binding fragment of any of embodiments 314-317, provided that $X_4$ is selected from D, F, K, R, S, and T.

319. The antibody or antigen-binding fragment of any of embodiments 314-312, provided that the LCDR3 comprises an amino acid sequence selected from SEQ ID NOS: 100315-100482.

320. The antibody or antigen-binding fragment of embodiment 293, provided that the HCDR1 comprises SEQ ID NO: 1009, the HCDR2 comprises SEQ ID NO: 10012, the HCDR3 comprises SEQ ID NO: 10015, the LCDR1 comprises SEQ ID NO: 10018, the LCDR2 comprises SEQ ID NO: 10021, and the LCDR3 comprises SEQ ID NO: 10024.

321. The antibody or antigen-binding fragment of embodiment 293, provided that the HCDR1 comprises SEQ ID NO: 100150, the HCDR2 comprises SEQ ID NO: 10012, the HCDR3 comprises SEQ ID NO: 100152, the LCDR1 comprises SEQ ID NO: 10018, the LCDR2 comprises SEQ ID NO: 10021, and the LCDR3 comprises SEQ ID NO: 100155.

322. The antibody or antigen-binding fragment of embodiment 293 or embodiment 321, provided that the $X_1$ of SEQ ID NO: 100150 is D.

323. The antibody or antigen-binding fragment of embodiment 293 or embodiment 321 provided that the $X_1$ of SEQ ID NO: 100150 is E.

324. The antibody or antigen-binding fragment of any of embodiments 293, 321-323, provided that the $X_2$ of SEQ ID NO: 100150 is.

325. The antibody or antigen-binding fragment of any of embodiments 293, 321-323, provided that the $X_2$ of SEQ ID NO: 100150 is P.

326. The antibody or antigen-binding fragment of any of embodiments 293, 321-323, provided that the $X_2$ of SEQ ID NO: 100150 is V.

327. The antibody or antigen-binding fragment of any of embodiments 293, 321-326, provided that the $X_3$ of SEQ ID NO: 100150 is G.

328. The antibody or antigen-binding fragment of any of embodiments 293, 321-326, provided that the $X_3$ of SEQ ID NO: 100150 is Q.

329. The antibody or antigen-binding fragment of any of embodiments 293, 321-326, provided that the $X_3$ of SEQ ID NO: 100150 is S.

330. The antibody or antigen-binding fragment of any of embodiments 293, 321-326, provided that the $X_3$ of SEQ ID NO: 100150 is V.

331. The antibody or antigen-binding fragment of any of embodiments 293, 321-330, provided that the $X_4$ of SEQ ID NO: 100150 is F.

332. The antibody or antigen-binding fragment of any of embodiments 293, 321-330, provided that the $X_4$ of SEQ ID NO: 100150 is Y.

333. The antibody or antigen-binding fragment of any of embodiments 293, 321-332, provided that the $X_5$ of SEQ ID NO: 100150 is I.

334. The antibody or antigen-binding fragment of any of embodiments 293, 321-332, provided that the $X_5$ of SEQ ID NO: 100150 is M.

335. The antibody or antigen-binding fragment of any of embodiments 293, 321-334, provided that the $X_1$ of SEQ ID NO: 100152 is L.

336. The antibody or antigen-binding fragment of any of embodiments 293, 321-334, provided that the $X_1$ of SEQ ID NO: 100152 is M.

337. The antibody or antigen-binding fragment of any of embodiments 293, 321-336, provided that the $X_2$ of SEQ ID NO: 100152 is E.

338. The antibody or antigen-binding fragment of any of embodiments 293, 321-336, provided that the $X_2$ of SEQ ID NO: 100152 is I.

339. The antibody or antigen-binding fragment of any of embodiments 293, 321-336, provided that the $X_2$ of SEQ ID NO: 100152 is K.

340. The antibody or antigen-binding fragment of any of embodiments 293, 321-336, provided that the $X_2$ of SEQ ID NO: 100152 is L.

341. The antibody or antigen-binding fragment of any of embodiments 293, 321-336, provided that the $X_2$ of SEQ ID NO: 100152 is M.

342. The antibody or antigen-binding fragment of any of embodiments 293, 321-336, provided that the $X_2$ of SEQ ID NO: 100152 is Q.

343. The antibody or antigen-binding fragment of any of embodiments 293, 321-336, provided that the $X_2$ of SEQ ID NO: 100152 is T.

344. The antibody or antigen-binding fragment of any of embodiments 293, 321-336, provided that the $X_2$ of SEQ ID NO: 100152 is V.

345. The antibody or antigen-binding fragment of any of embodiments 293, 321-336, provided that the $X_2$ of SEQ ID NO: 100152 is W.

346. The antibody or antigen-binding fragment of any of embodiments 293, 321-336, provided that the $X_2$ of SEQ ID NO: 100152 is Y.

347. The antibody or antigen-binding fragment of any of embodiments 293, 321-346, provided that the $X_1$ of SEQ ID NO: 100155 is Q.

348. The antibody or antigen-binding fragment of any of embodiments 293, 321-346, provided that the $X_1$ of SEQ ID NO: 100155 is N.

349. The antibody or antigen-binding fragment of any of embodiments 293, 321-348, provided that the $X_2$ of SEQ ID NO: 100155 is D.

350. The antibody or antigen-binding fragment of any of embodiments 293, 321-348, provided that the $X_2$ of SEQ ID NO: 100155 is E.

351. The antibody or antigen-binding fragment of any of embodiments 293, 321-348, provided that the $X_2$ of SEQ ID NO: 100155 is H.

352. The antibody or antigen-binding fragment of any of embodiments 293, 321-348, provided that the $X_2$ of SEQ ID NO: 100155 is N.

353. The antibody or antigen-binding fragment of any of embodiments 293, 321-348, provided that the $X_2$ of SEQ ID NO: 100155 is Q.

354. The antibody or antigen-binding fragment of any of embodiments 293, 321-348, provided that the $X_2$ of SEQ ID NO: 100155 is S.

355. The antibody or antigen-binding fragment of any of embodiments 293, 321-354, provided that the $X_3$ of SEQ ID NO: 100155 is A.

356. The antibody or antigen-binding fragment of any of embodiments 293, 321-354, provided that the $X_3$ of SEQ ID NO: 100155 is G.

357. The antibody or antigen-binding fragment of any of embodiments 293, 321-356, provided that the $X_4$ of SEQ ID NO: 100155 is D.

358. The antibody or antigen-binding fragment of any of embodiments 293, 321-356, provided that the $X_4$ of SEQ ID NO: 100155 is F.

359. The antibody or antigen-binding fragment of any of embodiments 293, 321-356, provided that the $X_4$ of SEQ ID NO: 100155 is K.

360. The antibody or antigen-binding fragment of any of embodiments 293, 321-356, provided that the $X_4$ of SEQ ID NO: 100155 is N.

361. The antibody or antigen-binding fragment of any of embodiments 293, 321-356, provided that the $X_4$ of SEQ ID NO: 100155 is R.

362. The antibody or antigen-binding fragment of any of embodiments 293, 321-356, provided that the $X_4$ of SEQ ID NO: 100155 is S.

363. The antibody or antigen-binding fragment of any of embodiments 293, 321-356, provided that the $X_4$ of SEQ ID NO: 100155 is T.

364. The antibody or antigen-binding fragment of any of embodiments 293-363, provided that the antibody or antigen-binding fragment specifically binds to human TL1A.

365. The antibody or antigen-binding fragment of embodiment 364, provided that the antibody or antigen-binding fragment specifically binds to human TL1A with a $K_d$ of $1 \times 10^{-9}$ M or less.

366. The antibody or antigen-binding fragment of embodiment 365, provided that the $K_d$ is measured using a method selected from a standard ELISA assay and SPR.

367. The antibody or antigen-binding fragment of any of embodiments 293-366, provided that the antibody or antigen-binding fragment inhibits binding of DR3 to human TL1A.

368. The antibody or antigen-binding fragment of any of embodiments 293-367, provided that the antibody or antigen-binding fragment inhibits binding of DcR3 to human TL1A.

369. The antibody or antigen-binding fragment of any of embodiments 293-368, provided that the antibody or antigen-binding fragment is a humanized antibody, a CDR-grafted antibody, a chimeric antibody, a Fab, a ScFv, or a combination thereof.

370. The antibody or antigen-binding fragment of any of embodiments 293-369, comprising a human CH1 domain.

371. The antibody or antigen-binding fragment of any of embodiments 293-370, comprising a human CH2 domain.

372. The antibody or antigen-binding fragment of embodiment 371, provided that that CH2 domain comprises at least one mutation selected from L234A, L235A, and G237A, as numbered using Kabat.

373. The antibody or antigen-binding fragment of any of embodiments 293-372, comprising a human CH3 domain.

374. A pharmaceutical composition comprising a therapeutically effective amount of the antibody or antigen-binding fragment of any of embodiments 293-373, and a pharmaceutically acceptable carrier.

375. A method of treating an inflammatory disease in a subject in need thereof, comprising administering to the subject a therapeutically effective amount of the antibody or antigen-binding fragment of any of embodiments 293-373.

376. The method of embodiment 375, provided that the inflammatory disease is inflammatory bowel disease.

377. The method of embodiment 376, provided that the inflammatory bowel disease comprises Crohn's disease.

378. The method of embodiment 377, provided that the subject has been determined to be non-responsive to anti-TNFalpha therapy.

379. The method of embodiment 377 or embodiment 378, provided that the subject has been determined to comprise a disease phenotype comprising non-stricturing/non-penetrating, stricturing, stricturing and penetrating, or isolated internal penetrating.

380. An antibody or antigen-binding fragment that specifically binds to TL1A, comprising:

a heavy chain variable region comprising three heavy chain complementarity-determining regions (HCDR1, HCDR2, and HCDR3) comprising
  (a) a HCDR1 selected from: (i) a HCDR1 comprising SEQ ID NO: 1009, (ii) a HCDR1 comprising SEQ ID NO: 100150, wherein $X_1$ is selected from D and E, $X_2$ is selected from I, P and V, $X_3$ is selected from G, Q, S, and V, $X_4$ is selected from F and Y, and $X_5$ is selected from I and M, (iii) a HCDR1 selected from SEQ ID NOS: 100200-100295, and (iv) a HCDR1 comprising an amino acid sequence that differs from a sequence selected from the group consisting of SEQ ID NOS: 1009, 100150 and 100200-100295 by up to five, four, three, or two amino acids,
  (b) a HCDR2 selected from: (i) a HCDR2 comprising SEQ ID NO: 10012, and (ii) a HCDR2 comprising an amino acid sequence that differs from SEQ ID NO: 10012 by up to five, four, three, or two amino acids, and
  (c) a HCDR3 selected from (i) a HCDR3 comprising SEQ ID NO: 10015, (ii) a HCDR3 comprising SEQ ID NO: 100152, wherein $X_1$ is selected from L and M, and $X_2$ is selected from E, I, K, L, M, Q, T, V, W, and Y, (iii) a HCDR3 selected from SEQ ID NOS: 100296-100314, and (iv) a HCDR3 comprising an amino acid sequence that differs from a sequence selected from the group consisting of SEQ ID NOS: 10015, 100152 and 100296-100314 by up to five, four, three, or two amino acids; and a light chain variable region comprising three light chain complementarity-determining regions (LCDR1, LCDR2, and LCDR3) comprising:
  (a) a LCDR1 selected from: (i) a LCDR1 comprising SEQ ID NO: 10018, and (ii) a LCDR1 comprising an amino acid sequence that differs from SEQ ID NO: 10018 by up to five, four, three, or two amino acids,
  (b) a LCDR2 selected from: (i) a LCDR2 comprising SEQ ID NO: 10021, and (ii) a LCDR2 comprising an amino acid sequence that differs from SEQ ID NO: 10021 by up to five, four, three, or two amino acids, and
  (c) a LCDR3 selected from (i) a LCDR3 comprising SEQ ID NO: 10024, (ii) a LCDR3 comprising SEQ ID NO: 100155, wherein $X_1$ is selected from Q and N, $X_2$ is selected from D, E, H, N, Q, and S, $X_3$ is selected from A and G, and $X_4$ is selected from D, F, K, N, R, S, and T, (iii) a LCDR3 selected from SEQ ID NOS: 100315-100482, and (iv) a LCDR3 comprising an amino acid sequence that differs from a sequence selected from the group consisting of SEQ ID NOS: 10024, 100155, and 100315-100482 by up to five, four, three, or two amino acids.

381. The antibody or antigen-binding fragment of embodiment 380, provided that the HCDR1 comprises SEQ ID NO: 100150, the HCDR2 comprises SEQ ID NO: 10012, the HCDR3 comprises SEQ ID NO: 100152, the LCDR1 comprises SEQ ID NO: 10018, the LCDR2 comprises SEQ ID NO: 10021, and the LCDR3 comprises SEQ ID NO: 100155.

382. The antibody or antigen-binding fragment of embodiment 380 or embodiment 381, provided that the $X_1$ of SEQ ID NO: 100150 is D.

383. The antibody or antigen-binding fragment of embodiment 380 or embodiment 381 provided that the $X_1$ of SEQ ID NO: 100150 is E.

384. The antibody or antigen-binding fragment of any of embodiments 380-383, provided that the $X_2$ of SEQ ID NO: 100150 is I.
385. The antibody or antigen-binding fragment of any of embodiments 380-383, provided that the $X_2$ of SEQ ID NO: 100150 is P.
386. The antibody or antigen-binding fragment of any of embodiments 380-383, provided that the $X_2$ of SEQ ID NO: 100150 is V.
387. The antibody or antigen-binding fragment of any of embodiments 380-386, provided that the $X_3$ of SEQ ID NO: 100150 is G.
388. The antibody or antigen-binding fragment of any of embodiments 380-386, provided that the $X_3$ of SEQ ID NO: 100150 is Q.
389. The antibody or antigen-binding fragment of any of embodiments 380-386, provided that the $X_3$ of SEQ ID NO: 100150 is S.
390. The antibody or antigen-binding fragment of any of embodiments 380-386, provided that the $X_3$ of SEQ ID NO: 100150 is V.
391. The antibody or antigen-binding fragment of any of embodiments 380-390, provided that the $X_4$ of SEQ ID NO: 100150 is F.
392. The antibody or antigen-binding fragment of any of embodiments 380-390, provided that the $X_4$ of SEQ ID NO: 100150 is Y.
393. The antibody or antigen-binding fragment of any of embodiments 380-392, provided that the $X_5$ of SEQ ID NO: 100150 is I.
394. The antibody or antigen-binding fragment of any of embodiments 380-392, provided that the $X_5$ of SEQ ID NO: 100150 is M.
395. The antibody or antigen-binding fragment of any of embodiments 380-394, provided that the $X_1$ of SEQ ID NO: 100152 is L.
396. The antibody or antigen-binding fragment of any of embodiments 380-394, provided that the $X_1$ of SEQ ID NO: 100152 is M.
397. The antibody or antigen-binding fragment of any of embodiments 380-396, provided that the $X_2$ of SEQ ID NO: 100152 is E.
398. The antibody or antigen-binding fragment of any of embodiments 380-396, provided that the $X_2$ of SEQ ID NO: 100152 is I.
399. The antibody or antigen-binding fragment of any of embodiments 380-396, provided that the $X_2$ of SEQ ID NO: 100152 is K.
400. The antibody or antigen-binding fragment of any of embodiments 380-396, provided that the $X_2$ of SEQ ID NO: 100152 is L.
401. The antibody or antigen-binding fragment of any of embodiments 380-396, provided that the $X_2$ of SEQ ID NO: 100152 is M.
402. The antibody or antigen-binding fragment of any of embodiments 380-396, provided that the $X_2$ of SEQ ID NO: 100152 is Q.
403. The antibody or antigen-binding fragment of any of embodiments 380-396, provided that the $X_2$ of SEQ ID NO: 100152 is T.
404. The antibody or antigen-binding fragment of any of embodiments 380-396, provided that the $X_2$ of SEQ ID NO: 100152 is V.
405. The antibody or antigen-binding fragment of any of embodiments 380-396, provided that the $X_2$ of SEQ ID NO: 100152 is W.
406. The antibody or antigen-binding fragment of any of embodiments 380-396, provided that the $X_2$ of SEQ ID NO: 100152 is Y.
407. The antibody or antigen-binding fragment of any of embodiments 380-406, provided that the $X_1$ of SEQ ID NO: 100155 is Q.
408. The antibody or antigen-binding fragment of any of embodiments 380-406, provided that the $X_1$ of SEQ ID NO: 100155 is N.
409. The antibody or antigen-binding fragment of any of embodiments 380-408, provided that the $X_2$ of SEQ ID NO: 100155 is D.
410. The antibody or antigen-binding fragment of any of embodiments 380-408, provided that the $X_2$ of SEQ ID NO: 100155 is E.
411. The antibody or antigen-binding fragment of any of embodiments 380-408, provided that the $X_2$ of SEQ ID NO: 100155 is H.
412. The antibody or antigen-binding fragment of any of embodiments 380-408, provided that the $X_2$ of SEQ ID NO: 100155 is N.
413. The antibody or antigen-binding fragment of any of embodiments 380-408, provided that the $X_2$ of SEQ ID NO: 100155 is Q.
414. The antibody or antigen-binding fragment of any of embodiments 380-408, provided that the $X_2$ of SEQ ID NO: 100155 is S.
415. The antibody or antigen-binding fragment of any of embodiments 380-414, provided that the $X_3$ of SEQ ID NO: 100155 is A.
416. The antibody or antigen-binding fragment of any of embodiments 380-414, provided that the $X_3$ of SEQ ID NO: 100155 is G.
417. The antibody or antigen-binding fragment of any of embodiments 380-416, provided that the $X_4$ of SEQ ID NO: 100155 is D.
418. The antibody or antigen-binding fragment of any of embodiments 380-416, provided that the $X_4$ of SEQ ID NO: 100155 is F.
419. The antibody or antigen-binding fragment of any of embodiments 380-416, provided that the $X_4$ of SEQ ID NO: 100155 is K.
420. The antibody or antigen-binding fragment of any of embodiments 380-416, provided that the $X_4$ of SEQ ID NO: 100155 is N.
421. The antibody or antigen-binding fragment of any of embodiments 380-416, provided that the $X_4$ of SEQ ID NO: 100155 is R.
422. The antibody or antigen-binding fragment of any of embodiments 380-416, provided that the $X_4$ of SEQ ID NO: 100155 is S.
423. The antibody or antigen-binding fragment of any of embodiments 380-416, provided that the $X_4$ of SEQ ID NO: 100155 is T.
424. The antibody or antigen-binding fragment of any of embodiments 380-423, provided that the antibody or antigen-binding fragment specifically binds to human TL1A.
425. The antibody or antigen-binding fragment of embodiment 424, provided that the antibody or antigen-binding fragment specifically binds to human TL1A with a $K_d$ of $1\times10^{-9}$ M or less.
426. The antibody or antigen-binding fragment of embodiment 425, provided that the $K_d$ is measured using a method selected from a standard ELISA assay and SPR.

427. The antibody or antigen-binding fragment of any of embodiments 380-426, provided that the antibody or antigen-binding fragment inhibits binding of DR3 to human TL1A.
428. The antibody or antigen-binding fragment of any of embodiments 380-427, provided that the antibody or antigen-binding fragment inhibits binding of DcR3 to human TL1A.
429. The antibody or antigen-binding fragment of any of embodiments 380-428, provided that the antibody or antigen-binding fragment is a humanized antibody, a CDR-grafted antibody, a chimeric antibody, a Fab, a ScFv, or a combination thereof.
430. The antibody or antigen-binding fragment of any of embodiments 380-429, comprising a human CH1 domain.
431. The antibody or antigen-binding fragment of any of embodiments 380-430, comprising a human CH2 domain.
432. The antibody or antigen-binding fragment of embodiment 431, provided that that CH2 domain comprises at least one mutation selected from L234A, L235A, and G237A, as numbered using Kabat.
433. The antibody or antigen-binding fragment of any of embodiments 380-432, comprising a human CH3 domain.
434. A pharmaceutical composition comprising a therapeutically effective amount of the antibody or antigen-binding fragment of any of embodiments 380-433, and a pharmaceutically acceptable carrier.
435. A method of treating an inflammatory disease in a subject in need thereof, comprising administering to the subject a therapeutically effective amount of the antibody or antigen-binding fragment of any of embodiments 380-433.
436. The method of embodiment 435, provided that the inflammatory disease is inflammatory bowel disease.
437. The method of embodiment 436, provided that the inflammatory bowel disease comprises Crohn's disease.
438. The method of embodiment 437, provided that the subject has been determined to be non-responsive to anti-TNFalpha therapy.
439. The method of embodiment 437 or embodiment 438, provided that the subject has been determined to comprise a disease phenotype comprising non-stricturing/non-penetrating, stricturing, stricturing and penetrating, or isolated internal penetrating.
440. An antibody or antigen-binding fragment that specifically binds to TL1A, comprising: a heavy chain variable region comprising SEQ ID NO: 10052 or SEQ ID NO: 10054, and a light chain variable region comprising SEQ ID NO: 10053.
441. The antibody or antigen-binding fragment of embodiment 440, provided that the heavy chain variable region comprises SEQ ID NO: 10052.
442. The antibody or antigen-binding fragment of embodiment 440, provided that the heavy chain variable region comprises SEQ ID NO: 10054.
443. The antibody or antigen-binding fragment of any of embodiments 440-442, provided that the $X_1$ of SEQ ID NO: 10052 or SEQ ID NO: 10054 is D.
444. The antibody or antigen-binding fragment of any of embodiments 440-442 provided that the $X_1$ of SEQ ID NO: 10052 or SEQ ID NO: 10054 is E.
445. The antibody or antigen-binding fragment of any of embodiments 440-444, provided that the $X_2$ of SEQ ID NO: 10052 or SEQ ID NO: 10054 is I.
446. The antibody or antigen-binding fragment of any of embodiments 440-444, provided that the $X_2$ of SEQ ID NO: 10052 or SEQ ID NO: 10054 is P.
447. The antibody or antigen-binding fragment of any of embodiments 440-444, provided that the $X_2$ of SEQ ID NO: 10052 or SEQ ID NO: 10054 is V.
448. The antibody or antigen-binding fragment of any of embodiments 440-447, provided that the $X_3$ of SEQ ID NO: 10052 or SEQ ID NO: 10054 is G.
449. The antibody or antigen-binding fragment of any of embodiments 440-447, provided that the $X_3$ of SEQ ID NO: 10052 or SEQ ID NO: 10054 is Q.
450. The antibody or antigen-binding fragment of any of embodiments 440-447, provided that the $X_3$ of SEQ ID NO: 10052 or SEQ ID NO: 10054 is S.
451. The antibody or antigen-binding fragment of any of embodiments 440-447, provided that the $X_3$ of SEQ ID NO: 10052 or SEQ ID NO: 10054 is V.
452. The antibody or antigen-binding fragment of any of embodiments 440-451, provided that the $X_4$ of SEQ ID NO: 10052 or SEQ ID NO: 10054 is F.
453. The antibody or antigen-binding fragment of any of embodiments 440-451, provided that the $X_4$ of SEQ ID NO: 10052 or SEQ ID NO: 10054 is Y.
454. The antibody or antigen-binding fragment of any of embodiments 440-453, provided that the $X_5$ of SEQ ID NO: 10052 or SEQ ID NO: 10054 is I.
455. The antibody or antigen-binding fragment of any of embodiments 440-453, provided that the $X_5$ of SEQ ID NO: 10052 or SEQ ID NO: 10054 is M.
456. The antibody or antigen-binding fragment of any of embodiments 440-455, provided that the $X_6$ of SEQ ID NO: 10052 or SEQ ID NO: 10054 is L.
457. The antibody or antigen-binding fragment of any of embodiments 440-455, provided that the $X_6$ of SEQ ID NO: 10052 or SEQ ID NO: 10054 is M.
458. The antibody or antigen-binding fragment of any of embodiments 440-457, provided that the $X_7$ of SEQ ID NO: 10052 or SEQ ID NO: 10054 is E.
459. The antibody or antigen-binding fragment of any of embodiments 440-457, provided that the $X_7$ of SEQ ID NO: 10052 or SEQ ID NO: 10054 is I.
460. The antibody or antigen-binding fragment of any of embodiments 440-457, provided that the $X_7$ of SEQ ID NO: 10052 or SEQ ID NO: 10054 is K.
461. The antibody or antigen-binding fragment of any of embodiments 440-457, provided that the $X_7$ of SEQ ID NO: 10052 or SEQ ID NO: 10054 is L.
462. The antibody or antigen-binding fragment of any of embodiments 440-457, provided that the $X_7$ of SEQ ID NO: 10052 or SEQ ID NO: 10054 is M.
463. The antibody or antigen-binding fragment of any of embodiments 440-457, provided that the $X_7$ of SEQ ID NO: 10052 or SEQ ID NO: 10054 is Q.
464. The antibody or antigen-binding fragment of any of embodiments 440-457, provided that the $X_7$ of SEQ ID NO: 10052 or SEQ ID NO: 10054 is T.
465. The antibody or antigen-binding fragment of any of embodiments 440-457, provided that the $X_7$ of SEQ ID NO: 10052 or SEQ ID NO: 10054 is V.
466. The antibody or antigen-binding fragment of any of embodiments 440-457, provided that the $X_7$ of SEQ ID NO: 10052 or SEQ ID NO: 10054 is W.

467. The antibody or antigen-binding fragment of any of embodiments 440-457, provided that the $X_7$ of SEQ ID NO: 10052 or SEQ ID NO: 10054 is Y.
468. The antibody or antigen-binding fragment of any of embodiments 440-467, provided that the $X_1$ of SEQ ID NO: 10053 is Q.
469. The antibody or antigen-binding fragment of any of embodiments 440-467, provided that the $X_1$ of SEQ ID NO: 10053 is N.
470. The antibody or antigen-binding fragment of any of embodiments 440-469, provided that the $X_2$ of SEQ ID NO: 10053 is D.
471. The antibody or antigen-binding fragment of any of embodiments 440-469, provided that the $X_2$ of SEQ ID NO: 10053 is E.
472. The antibody or antigen-binding fragment of any of embodiments 440-469, provided that the $X_2$ of SEQ ID NO: 10053 is H.
473. The antibody or antigen-binding fragment of any of embodiments 440-469, provided that the $X_2$ of SEQ ID NO: 10053 is N.
474. The antibody or antigen-binding fragment of any of embodiments 440-469, provided that the $X_2$ of SEQ ID NO: 10053 is Q.
475. The antibody or antigen-binding fragment of any of embodiments 440-469, provided that the $X_2$ of SEQ ID NO: 10053 is S.
476. The antibody or antigen-binding fragment of any of embodiments 440-475, provided that the $X_3$ of SEQ ID NO: 10053 is A.
477. The antibody or antigen-binding fragment of any of embodiments 440-475, provided that the $X_3$ of SEQ ID NO: 10053 is G.
478. The antibody or antigen-binding fragment of any of embodiments 440-477, provided that the $X_4$ of SEQ ID NO: 10053 is D.
479. The antibody or antigen-binding fragment of any of embodiments 440-477, provided that the $X_4$ of SEQ ID NO: 10053 is F.
480. The antibody or antigen-binding fragment of any of embodiments 440-477, provided that the $X_4$ of SEQ ID NO: 10053 is K.
481. The antibody or antigen-binding fragment of any of embodiments 440-477, provided that the $X_4$ of SEQ ID NO: 10053 is N.
482. The antibody or antigen-binding fragment of any of embodiments 440-477, provided that the $X_4$ of SEQ ID NO: 10053 is R.
483. The antibody or antigen-binding fragment of any of embodiments 440-477, provided that the $X_4$ of SEQ ID NO: 10053 is S.
484. The antibody or antigen-binding fragment of any of embodiments 440-477, provided that the $X_4$ of SEQ ID NO: 10053 is T.
485. An antibody or antigen-binding fragment that specifically binds to TLA, comprising: a heavy chain variable region of SEQ ID NO: 10036, and a light chain variable region of SEQ ID NO: 10038.
486. An antibody or antigen-binding fragment that specifically binds to TLA, comprising: a heavy chain variable region of SEQ ID NO: 10040, and a light chain variable region of SEQ ID NO: 10042.
487. An antibody or antigen-binding fragment that specifically binds to TL1A, comprising: a heavy chain variable region of SEQ ID NO: 10040, and a light chain variable region of SEQ ID NO: 10038.
488. An antibody or antigen-binding fragment that specifically binds to TLA, comprising: a heavy chain variable region of SEQ ID NO: 10044, and a light chain variable region of SEQ ID NO: 10038.
489. An antibody or antigen-binding fragment that specifically binds to TL1A, comprising: a heavy chain variable region of SEQ ID NO: 10043, and a light chain variable region of SEQ ID NO: 10038.
490. An antibody or antigen-binding fragment that specifically binds to TL1A, comprising: a heavy chain variable region of SEQ ID NO: 10045, and a light chain variable region of SEQ ID NO: 10038.
491. An antibody or antigen-binding fragment that specifically binds to TL1A, comprising: a heavy chain variable region of SEQ ID NO: 10046, and a light chain variable region of SEQ ID NO: 10038.
492. An antibody or antigen-binding fragment that specifically binds to TLA, comprising: a heavy chain variable region of SEQ ID NO: 10040, and a light chain variable region of SEQ ID NO: 10047.
493. An antibody or antigen-binding fragment that specifically binds to TL1A, comprising: a heavy chain variable region of SEQ ID NO: 10040, and a light chain variable region of SEQ ID NO: 10048.
494. An antibody or antigen-binding fragment that specifically binds to TLA, comprising: a heavy chain variable region of SEQ ID NO: 10040, and a light chain variable region of SEQ ID NO: 10049. 495. An antibody or antigen-binding fragment that specifically binds to TLA, comprising: a heavy chain variable region of SEQ ID NO: 10040, and a light chain variable region of SEQ ID NO: 10050.
496. An antibody or antigen-binding fragment that specifically binds to TLA, comprising: a heavy chain variable region of SEQ ID NO: 10040, and a light chain variable region of SEQ ID NO: 10051.
497. The antibody or antigen-binding fragment of any of embodiments 440-496, provided that the antibody or antigen-binding fragment specifically binds to human TLA.
498. The antibody or antigen-binding fragment of embodiment 497, provided that the antibody or antigen-binding fragment specifically binds to human TL1A with a $K_d$ of $1\times10^{-9}$ M or less.
499. The antibody or antigen-binding fragment of embodiment 498, provided that the $K_d$ is measured using a method selected from a standard ELISA assay and SPR.
500. The antibody or antigen-binding fragment of any of embodiments 440-499, provided that the antibody or antigen-binding fragment inhibits binding of DR3 to human TLA.
501. The antibody or antigen-binding fragment of any of embodiments 440-500, provided that the antibody or antigen-binding fragment inhibits binding of DcR3 to human TL1A.
502. The antibody or antigen-binding fragment of any of embodiments 440-501, provided that the antibody or antigen-binding fragment is a humanized antibody, a CDR-grafted antibody, a chimeric antibody, a Fab, a ScFv, or a combination thereof.
503. The antibody or antigen-binding fragment of any of embodiments 440-502, comprising a human CH1 domain.
504. The antibody or antigen-binding fragment of any of embodiments 440-503, comprising a human CH2 domain.

505. The antibody or antigen-binding fragment of embodiment 504, provided that that CH2 domain comprises at least one mutation selected from L234A, L235A, and G237A, as numbered using Kabat.

506. The antibody or antigen-binding fragment of any of embodiments 440-505, comprising a human CH3 domain.

507. A pharmaceutical composition comprising a therapeutically effective amount of the antibody or antigen-binding fragment of any of embodiments 440-506, and a pharmaceutically acceptable carrier.

508. A method of treating an inflammatory disease in a subject in need thereof, comprising administering to the subject a therapeutically effective amount of the antibody or antigen-binding fragment of any of embodiments 440-506.

509. The method of embodiment 508, provided that the inflammatory disease is inflammatory bowel disease.

510. The method of embodiment 509, provided that the inflammatory bowel disease comprises Crohn's disease.

511. The method of embodiment 510, provided that the subject has been determined to be non-responsive to anti-TNFalpha therapy.

512. The method of embodiment 510 or embodiment 511, provided that the subject has been determined to comprise a disease phenotype comprising non-stricturing/non-penetrating, stricturing, stricturing and penetrating, or isolated internal penetrating.

513. An antibody or antigen binding fragment that binds to the same region of human TL1A as a reference antibody of any of embodiments 1-112, 119-199, 206-286, 293-373, 380-433, and 440-506.

514. An antibody or antigen binding fragment that binds to the same region of human TL1A as a reference antibody comprising a heavy chain variable region of SEQ ID NO: 10036, and a light chain variable region of SEQ ID NO: 10038.

515. An antibody or antigen binding fragment that binds to the same region of human TL1A as a reference antibody comprising a heavy chain variable region of SEQ ID NO: 10040, and a light chain variable region of SEQ ID NO: 10042.

516. An antibody or antigen binding fragment that binds to the same region of human TL1A as a reference antibody comprising a heavy chain variable region of SEQ ID NO: 10040, and a light chain variable region of SEQ ID NO: 10038.

517. An antibody or antigen-binding fragment that specifically binds to TL1A, comprising:
a heavy chain variable region comprising:
  (a) an HCDR1 comprising an amino acid sequence set forth by SEQ ID NO: 553;
  (b) an HCDR2 comprising an amino acid sequence set forth by any one of SEQ ID NOs: 554 to 564 or 574 to 577; and
  (c) an HCDR3 comprising an amino acid sequence set forth by any one of SEQ ID NOs: 565 to 568 or 578 to 581; and
a light chain variable region comprising:
  (d) an LCDR1 comprising an amino acid sequence set forth by any one of SEQ ID NOs: 569 or 570;
  (e) an LCDR2 comprising an amino acid sequence set forth by SEQ ID NO: 488; and
  (f) an LCDR3 comprising an amino acid sequence set forth by any one of SEQ ID NOs: 571 to 573 or 582 to 585.

518. An antibody or antigen-binding fragment that specifically binds to TL1A, comprising:
a heavy chain variable region comprising:
  (a) an HCDR1 comprising an amino acid sequence set forth by SEQ ID NO: 553;
  (b) an HCDR2 comprising an amino acid sequence set forth by SEQ ID NO: 559; and
  (c) an HCDR3 comprising an amino acid sequence set forth by SEQ ID NO: 567; and
a light chain variable region comprising:
  (d) an LCDR1 comprising an amino acid sequence set forth by SEQ ID NO: 569;
  (e) an LCDR2 comprising an amino acid sequence set forth by SEQ ID NO: 488; and
  (f) an LCDR3 comprising an amino acid sequence set forth by any one of SEQ ID NO: 573.

519. An antibody or antigen-binding fragment that specifically binds to TLA, comprising:
a heavy chain variable region comprising:
  (a) an HCDR1 comprising an amino acid sequence set forth by SEQ ID NO: 553;
  (b) an HCDR2 comprising an amino acid sequence set forth by SEQ ID NO: 563; and
  (c) an HCDR3 comprising an amino acid sequence set forth by SEQ ID NO: 568; and
a light chain variable region comprising:
  (d) an LCDR1 comprising an amino acid sequence set forth by SEQ ID NO: 569;
  (e) an LCDR2 comprising an amino acid sequence set forth by SEQ ID NO: 488; and
  (f) an LCDR3 comprising an amino acid sequence set forth by any one of SEQ ID NO: 572.

520. An antibody or antigen-binding fragment that specifically binds to TL1A, comprising:
a heavy chain variable region comprising:
  (a) an HCDR1 comprising an amino acid sequence set forth by SEQ ID NO: 553;
  (b) an HCDR2 comprising an amino acid sequence set forth by SEQ ID NO: 555; and
  (c) an HCDR3 comprising an amino acid sequence set forth by SEQ ID NO: 566; and
a light chain variable region comprising:
  (d) an LCDR1 comprising an amino acid sequence set forth by SEQ ID NO: 569;
  (e) an LCDR2 comprising an amino acid sequence set forth by SEQ ID NO: 488; and
  (f) an LCDR3 comprising an amino acid sequence set forth by any one of SEQ ID NO: 572.

521. An antibody or antigen-binding fragment that specifically binds to TL1A, comprising:
a heavy chain variable region comprising:
  (a) an HCDR1 comprising an amino acid sequence set forth by SEQ ID NO: 553;
  (b) an HCDR2 comprising an amino acid sequence set forth by SEQ ID NO: 558; and
  (c) an HCDR3 comprising an amino acid sequence set forth by SEQ ID NO: 566; and
a light chain variable region comprising:
  (d) an LCDR1 comprising an amino acid sequence set forth by SEQ ID NO: 569;
  (e) an LCDR2 comprising an amino acid sequence set forth by SEQ ID NO: 488; and
  (f) an LCDR3 comprising an amino acid sequence set forth by any one of SEQ ID NO: 572.

522. An antibody or antigen-binding fragment that specifically binds to TLA, comprising:
a heavy chain variable region comprising:
- (a) an HCDR1 comprising an amino acid sequence set forth by SEQ ID NO: 553;
- (b) an HCDR2 comprising an amino acid sequence set forth by SEQ ID NO: 564; and
- (c) an HCDR3 comprising an amino acid sequence set forth by SEQ ID NO: 568; and a light chain variable region comprising:
- (d) an LCDR1 comprising an amino acid sequence set forth by SEQ ID NO: 569;
- (e) an LCDR2 comprising an amino acid sequence set forth by SEQ ID NO: 488; and
- (f) an LCDR3 comprising an amino acid sequence set forth by any one of SEQ ID NO: 572.

523. An antibody or antigen-binding fragment that specifically binds to TLA, comprising:
- (a) a heavy chain variable region comprising an HCDR1, an HCDR2, and an HCDR3 from any one of SEQ ID NOs: 491, 493, 495, 497, 499, 501, 503, 505, 507, 509, 511, 513, 515, 517, 519, 521, 523, 525, 527, 529, 531, 533, 535, 537, 539, or 541; and
- (b) a light chain variable region comprising an LCDR1, an LCDR2, and an LCDR3 from any one of SEQ ID NOs: 490, 492, 494, 496, 498, 500, 502, 504, 506, 508, 510, 512, 514, 516, 518, 520, 522, 524, 526, 528, 530, 532, 534, 536, 538, or 540; wherein the CDRs are defined by the Kabat, Chothia, or IMGT method or a combination thereof.

524. The antibody or antigen-binding fragment of any one of embodiments 517 to 523, comprising a human heavy chain framework region 1 that is at least 90%, 95%, 96%, 97%, 98%, 99% identical to that set forth is SEQ ID NO: 545.

525. The antibody or antigen-binding fragment of any one of embodiments 517 to 524, comprising a human heavy chain framework region 2 that is at least 90%, 95%, 96%, 97%, 98%, 99% identical to that set forth is SEQ ID NO: 546.

526. The antibody or antigen-binding fragment of any one of embodiments 517 to 525, comprising a human heavy chain framework region 3 that is at least 90%, 95%, 96%, 97%, 98%, 99% identical to that set forth is SEQ ID NO: 547 or 586 to 588.

527. The antibody or antigen-binding fragment of any one of embodiments 517 to 526, comprising a human heavy chain framework region 4 that is at least 90%, 95%, 96%, 97%, 98%, 99% identical to that set forth is SEQ ID NO: 548.

528. The antibody or antigen-binding fragment of any one of embodiments 517 to 527, comprising a human light chain framework region 1 that is at least 90%, 95%, 96%, 97%, 98%, 99% identical to that set forth is SEQ ID NO: 549.

529. The antibody or antigen-binding fragment of any one of embodiments 517 to 528, comprising a human light chain framework region 2 that is at least 90%, 95%, 96%, 97%, 98%, 99% identical to that set forth is SEQ ID NO: 550.

530. The antibody or antigen-binding fragment of any one of embodiments 517 to 529, comprising a human light chain framework region 3 that is at least 90%, 95%, 96%, 97%, 98%, 99% identical to that set forth is SEQ ID NO: 551.

531. The antibody or antigen-binding fragment of any one of embodiments 517 to 530, comprising a human light chain framework region 4 that is at least 90%, 95%, 96%, 97%, 98%, 99% identical to that set forth is SEQ ID NO: 552.

532. The antibody or antigen-binding fragment of any one of embodiments 517 to 531, comprising:
- (a) a human heavy chain framework region 1 that is at least 90% identical to that set forth is SEQ ID NO: 545;
- (b) a human heavy chain framework region 2 that is at least 90% identical to that set forth is SEQ ID NO: 546;
- (c) a human heavy chain framework region 3 that is at least 90% identical to that set forth is SEQ ID NO: 547 or 586 to 588;
- (d) a human heavy chain framework region 4 that is at least 90% identical to that set forth is SEQ ID NO: 548;
- (e) a human light chain framework region 1 that is at least 90% identical to that set forth is SEQ ID NO: 549;
- (f) a human light chain framework region 2 that is at least 90% identical to that set forth is SEQ ID NO: 550;
- (g) a human light chain framework region 3 that is at least 90% identical to that set forth is SEQ ID NO: 551; and
- (h) a human light chain framework region 4 that is at least 90% identical to that set forth is SEQ ID NO: 552.

533. The antibody or antigen-binding fragment of embodiment 532, comprising:
- (a) a human heavy chain framework region 1 that is at least 95% identical to that set forth is SEQ ID NO: 545;
- (b) a human heavy chain framework region 2 that is at least 95% identical to that set forth is SEQ ID NO: 546;
- (c) a human heavy chain framework region 3 that is at least 95% identical to that set forth is SEQ ID NO: 547 or 586 to 588;
- (d) a human heavy chain framework region 4 that is at least 95% identical to that set forth is SEQ ID NO: 548;
- (e) a human light chain framework region 1 that is at least 95% identical to that set forth is SEQ ID NO: 549;
- (f) a human light chain framework region 2 that is at least 95% identical to that set forth is SEQ ID NO: 550;
- (g) a human light chain framework region 3 that is at least 95% identical to that set forth is SEQ ID NO: 551; and
- (h) a human light chain framework region 4 that is at least 95% identical to that set forth is SEQ ID NO: 552.

534. The antibody or antigen-binding fragment of embodiments 532, comprising:
- (a) a human heavy chain framework region 1 that is at least 97% identical to that set forth is SEQ ID NO: 545;
- (b) a human heavy chain framework region 2 that is at least 97% identical to that set forth is SEQ ID NO: 546;
- (c) a human heavy chain framework region 3 that is at least 97% identical to that set forth is SEQ ID NO: 547 or 586 to 588;

(d) a human heavy chain framework region 4 that is at least 97% identical to that set forth is SEQ ID NO: 548;
(e) a human light chain framework region 1 that is at least 97% identical to that set forth is SEQ ID NO: 549;
(f) a human light chain framework region 2 that is at least 97% identical to that set forth is SEQ ID NO: 550;
(g) a human light chain framework region 3 that is at least 97% identical to that set forth is SEQ ID NO: 551; and
(h) a human light chain framework region 4 that is at least 97% identical to that set forth is SEQ ID NO: 552.

535. The antibody or antigen-binding fragment of embodiment 532, comprising:
(a) a human heavy chain framework region 1 that is at least 98% identical to that set forth is SEQ ID NO: 545;
(b) a human heavy chain framework region 2 that is at least 98% identical to that set forth is SEQ ID NO: 546;
(c) a human heavy chain framework region 3 that is at least 98% identical to that set forth is SEQ ID NO: 547 or 586 to 588;
(d) a human heavy chain framework region 4 that is at least 98% identical to that set forth is SEQ ID NO: 548;
(e) a human light chain framework region 1 that is at least 98% identical to that set forth is SEQ ID NO: 549;
(f) a human light chain framework region 2 that is at least 98% identical to that set forth is SEQ ID NO: 550;
(g) a human light chain framework region 3 that is at least 98% identical to that set forth is SEQ ID NO: 551; and
(h) a human light chain framework region 4 that is at least 98% identical to that set forth is SEQ ID NO: 552.

536. An antibody or antigen-binding fragment that specifically binds to TL1A, comprising:
(a) a heavy chain variable region comprising an amino acid sequence at least about 85%, 90%, 95%, 97%, 98%, 99%, or 100% identical to any one of SEQ ID NOs: 491, 493, 495, 497, 499, 501, 503, 505, 507, 509, 511, 513, 515, 517, 519, 521, 523, 525, 527, 529, 531, 533, 535, 537, 539, or 541; and
(b) a light chain variable region comprising an amino acid sequence at least about 85%, 90%, 95%, 97%, 98%, 99%, or 100% identical to any one of SEQ ID NOs: 490, 492, 494, 496, 498, 500, 502, 504, 506, 508, 510, 512, 514, 516, 518, 520, 522, 524, 526, 528, 530, 532, 534, 536, 538, or 540.

537. An antibody or antigen-binding fragment that specifically binds to TL1A, comprising:
(a) a heavy chain variable region comprising an amino acid sequence at least about 85%, 90%, 95%, 97%, 98%, 99%, or 100% identical to SEQ ID NO: 503; and
(b) a light chain variable region comprising an amino acid sequence at least about 85%, 90%, 95%, 97%, 98%, 99%, or 100% identical to SEQ ID NO: 502.

538. An antibody or antigen-binding fragment that specifically binds to TLA, comprising:
(a) a heavy chain variable region comprising an amino acid sequence at least about 85%, 90%, 95%, 97%, 98%, 99%, or 100% identical to SEQ ID NO: 511; and
(b) a light chain variable region comprising an amino acid sequence at least about 85%, 90%, 95%, 97%, 98%, 99%, or 100% identical to SEQ ID NO: 510.

539. An antibody or antigen-binding fragment that specifically binds to TLA, comprising:
(a) a heavy chain variable region comprising an amino acid sequence at least about 85%, 90%, 95%, 97%, 98%, 99%, or 100% identical to SEQ ID NO: 493; and
(b) a light chain variable region comprising an amino acid sequence at least about 85%, 90%, 95%, 97%, 98%, 99%, or 100% identical to SEQ ID NO: 492.

540. An antibody or antigen-binding fragment that specifically binds to TL1A, comprising:
(a) a heavy chain variable region comprising an amino acid sequence at least about 85%, 90%, 95%, 97%, 98%, 99%, or 100% identical to SEQ ID NO: 501; and
(b) a light chain variable region comprising an amino acid sequence at least about 85%, 90%, 95%, 97%, 98%, 99%, or 100% identical to SEQ ID NO: 500.

541. An antibody or antigen-binding fragment that specifically binds to TLA, comprising:
(a) a heavy chain variable region comprising an amino acid sequence at least about 85%, 90%, 95%, 97%, 98%, 99%, or 100% identical to SEQ ID NO: 515; and
(b) a light chain variable region comprising an amino acid sequence at least about 85%, 90%, 95%, 97%, 98%, 99%, or 100% identical to SEQ ID NO: 514.

542. The antibody or antigen-binding fragment of any one of embodiments 517 to 541, wherein the antibody or antigen-binding fragment is chimeric or humanized.

543. The antibody or antigen-binding fragment of any one of embodiments 517 to 541, wherein the antibody or antigen-binding fragment is an IgG antibody.

544. The antibody or antigen-binding fragment of any one of embodiments 517 to 541, wherein the antibody or antigen-binding fragment comprises a Fab, F(ab)$_2$, a single-domain antibody, a single chain variable fragment (scFv), or a nanobody.

545. The antibody or antigen-binding fragment of any one of embodiments 517 to 544, comprising a heavy chain constant region comprising an amino acid sequence as set forth by SEQ ID NO: 542 or 543.

546. The antibody or antigen-binding fragment of any one of embodiments 517 to 544, comprising a heavy chain constant region comprising an amino acid sequence as set forth by SEQ ID NO: 542.

547. The antibody or antigen-binding fragment of any one of embodiments 517 to 544, comprising a light chain constant region comprising an amino acid sequence as set forth by SEQ ID NO: 544.

Non-limiting methods for determining whether an anti-TL1A antibody binds to the same region of a reference antibody are known in the art. An exemplary method comprises a competition assay. For instance, the method comprises determining whether a reference antibody can compete with binding between the reference antibody and the TL1A protein or portion thereof, or determining whether the reference antibody can compete with binding between the reference antibody and the TL1A protein or portion thereof. Exemplary methods include use of surface plasmon resonance to evaluate whether an anti-TL1A antibody can compete with the binding between TL1A and another anti-TL1A antibody. In some cases, surface plasmon resonance is utilized in the competition assay.

Pharmaceutical Compositions, Formulations, and Methods of Administration

In one aspect, a method for treating any of the diseases or conditions described herein in a subject in need of such treatment, involves administration of pharmaceutical compositions that include a therapeutic agent described herein, e.g., an inhibitor of CD30L, in therapeutically effective amounts to said subject. In some embodiments, a therapeutic agent described herein is used in the preparation of medicaments for treating an inflammatory disease, fibrostenotic disease, and/or fibrotic disease. Pharmaceutical compositions as used herein include compositions comprising an inhibitor of CD30L and optionally an additional therapeutic agent.

In certain embodiments, the compositions containing the therapeutic agent described herein are administered for prophylactic and/or therapeutic treatments. In certain therapeutic applications, the compositions are administered to a patient already suffering from a disease or condition, in an amount sufficient to cure or at least partially arrest at least one of the symptoms of the disease or condition. Amounts effective for this use depend on the severity and course of the disease or condition, previous therapy, the patient's health status, weight, and response to the drugs, and the judgment of the treating physician. Therapeutically effective amounts are optionally determined by methods including, but not limited to, a dose escalation clinical trial. In some cases, an inhibitor of CD30L is administered to a patient suffering from an inflammatory disease, fibrostenotic disease, and/or fibrotic disease.

In prophylactic applications, compositions containing a therapeutic agent described herein are administered to a patient susceptible to or otherwise at risk of a particular disease, disorder or condition, e.g., an inflammatory disease, fibrostenotic disease, and/or fibrotic disease. Such an amount is defined to be a "prophylactically effective amount or dose." In this use, the precise amounts also depend on the patient's state of health, weight, and the like. When used in a patient, effective amounts for this use will depend on the severity and course of the disease, disorder or condition, previous therapy, the patient's health status and response to the drugs, and the judgment of the treating physician. In one aspect, prophylactic treatments include administering to a mammal, who previously experienced at least one symptom of the disease being treated and is currently in remission, a pharmaceutical composition comprising an inhibitor of CD30L in order to prevent a return of the symptoms of the disease or condition.

In certain embodiments wherein the patient's condition does not improve, upon the doctor's discretion the administration of therapeutic agent is administered chronically, that is, for an extended period of time, including throughout the duration of the patient's life in order to ameliorate or otherwise control or limit the symptoms of the patient's disease or condition.

In certain embodiments wherein a patient's status does improve, the dose of therapeutic agent being administered may be temporarily reduced or temporarily suspended for a certain length of time (i.e., a "drug holiday"). In specific embodiments, the length of the drug holiday is between 2 days and 1 year, including by way of example only, 2 days, 3 days, 4 days, 5 days, 6 days, 7 days, 10 days, 12 days, 15 days, 20 days, 28 days, or more than 28 days. The dose reduction during a drug holiday is, by way of example only, by 10%-100%, including by way of example only 10%, 15%, 20%, 25%, 30%, 35%, 40%, 45%, 50%, 55%, 60%, 65%, 70%, 75%, 80%, 85%, 90%, 95%, and 100%.

In certain embodiments, the dose of drug being administered may be temporarily reduced or temporarily suspended for a certain length of time (i.e., a "drug diversion"). In specific embodiments, the length of the drug diversion is between 2 days and 1 year, including by way of example only, 2 days, 3 days, 4 days, 5 days, 6 days, 7 days, 10 days, 12 days, 15 days, 20 days, 28 days, or more than 28 days. The dose reduction during a drug diversion is, by way of example only, by 10%-100%, including by way of example only 10%, 15%, 20%, 25%, 30%, $3^5$%, 40%, 45%, 50%, 55%, 60%, 65%, 70%, 75%, 80%, 85%, 90%, 95%, and 100%. After a suitable length of time, the normal dosing schedule is optionally reinstated.

In some embodiments, once improvement of the patient's conditions has occurred, a maintenance dose is administered if necessary. Subsequently, in specific embodiments, the dosage or the frequency of administration, or both, is reduced, as a function of the symptoms, to a level at which the improved disease, disorder or condition is retained. In certain embodiments, however, the patient requires intermittent treatment on a long-term basis upon any recurrence of symptoms.

The amount of a given therapeutic agent that corresponds to such an amount varies depending upon factors such as the particular therapeutic agent, disease condition and its severity, the identity (e.g., weight, sex) of the subject in need of treatment, but can nevertheless be determined according to the particular circumstances surrounding the case, including, e.g., the specific agent being administered, the route of administration, the condition being treated, and the subject or host being treated. In general, however, doses employed for adult human treatment are typically in the range of 0.01 mg-5000 mg per day. In one aspect, doses employed for adult human treatment are from about 1 mg to about 1000 mg per day. In one embodiment, the desired dose is conveniently presented in a single dose or in divided doses administered simultaneously (or over a short period of time) or at appropriate intervals, for example as two, three, four or more sub-doses per day.

In some embodiments, as a patient is started on a regimen of a therapeutic agent, the patient is also weaned off (e.g., step-wise decrease in dose) a second treatment regimen.

In one embodiment, the daily dosages appropriate for an inhibitor of CD30L herein are from about 0.01 to about 10 mg/kg per body weight. In specific embodiments, an indicated daily dosage in a large mammal, including, but not limited to, humans, is in the range from about 0.5 mg to about 1000 mg, conveniently administered in divided doses, including, but not limited to, up to four times a day. In some embodiments, the daily dosage is administered in extended release form. In certain embodiments, suitable unit dosage forms for oral administration comprise from about 1 to 500 mg active ingredient. In some embodiments, the daily dosage or the amount of active in the dosage form are lower or higher than the ranges indicated herein, based on a number of variables in regard to an individual treatment regime. In various embodiments, the daily and unit dosages are altered depending on a number of variables including, but not limited to, the activity of the therapeutic agent used, the disease or condition to be treated, the mode of administration, the requirements of the individual subject, the severity of the disease or condition being treated, and the judgment of the practitioner.

Toxicity and therapeutic efficacy of such therapeutic regimens are determined by standard pharmaceutical procedures in cell cultures or experimental animals, including, but not limited to, the determination of the $LD_{50}$ and the $ED_{50}$. The dose ratio between the toxic and therapeutic effects is the therapeutic index and it is expressed as the ratio between $LD_{50}$ and $ED_{50}$. In certain embodiments, the data obtained from cell culture assays and animal studies are used in formulating the therapeutically effective daily dosage range and/or the therapeutically effective unit dosage amount for use in mammals, including humans. In some embodiments, the daily dosage amount of the therapeutic agent described herein lies within a range of circulating concentrations that include the $ED_{50}$ with minimal toxicity. In certain embodiments, the daily dosage range and/or the unit dosage amount varies within this range depending upon the dosage form employed and the route of administration utilized.

Disclosed herein are therapeutic agents formulated into pharmaceutical compositions. The pharmaceutical composition may comprise an inhibitor of anti-CD30L. The pharmaceutical composition may comprise an antibody. The pharmaceutical composition may comprise an anti-CD30L antibody.

Pharmaceutical compositions are formulated in a conventional manner using one or more pharmaceutically acceptable inactive ingredients that facilitate processing of the active therapeutic agent into preparations that can be used pharmaceutically. Proper formulation is dependent upon the route of administration chosen. A summary of pharmaceutical compositions described herein can be found, for example, in Remington: The Science and Practice of Pharmacy, Nineteenth Ed (Easton, Pa.: Mack Publishing Company, 1995); Hoover, John E., Remington's Pharmaceutical Sciences, Mack Publishing Co., Easton, Pa. 1975; Liberman, H. A. and Lachman, L., Eds., Pharmaceutical Dosage Forms, Marcel Decker, New York, N.Y., 1980; and Pharmaceutical Dosage Forms and Drug Delivery Systems, Seventh Ed. (Lippincott Williams & Wilkins, 1999), herein incorporated by reference for such disclosure.

Provided herein are pharmaceutical compositions that include an inhibitor of CD30L, and at least one pharmaceutically acceptable inactive ingredient. Optionally, the compositions include other therapeutic agent as discussed herein. In some embodiments, the therapeutic agents described herein are administered as pharmaceutical compositions in which the therapeutic agents are mixed with other active ingredients, as in combination therapy. In some embodiments, the pharmaceutical compositions include other medicinal or pharmaceutical agents, carriers, adjuvants, preserving, stabilizing, wetting or emulsifying agents, solution promoters, salts for regulating the osmotic pressure, and/or buffers. In some embodiments, the pharmaceutical compositions include other therapeutically valuable substances.

A pharmaceutical composition, as used herein, refers to a mixture of a therapeutic agent, e.g., an inhibitor of CD30L, with other chemical components (i.e. pharmaceutically acceptable inactive ingredients), such as carriers, excipients, binders, filling agents, suspending agents, flavoring agents, sweetening agents, disintegrating agents, dispersing agents, surfactants, lubricants, colorants, diluents, solubilizers, moistening agents, plasticizers, stabilizers, penetration enhancers, wetting agents, anti-foaming agents, antioxidants, preservatives, or one or more combination thereof. Optionally, the compositions include two or more therapeutic agent as discussed herein. In practicing the methods of treatment or use provided herein, therapeutically effective amounts of therapeutic agents described herein are administered in a pharmaceutical composition to a mammal having a disease, disorder, or condition to be treated, e.g., an inflammatory disease, fibrostenotic disease, and/or fibrotic disease. In some embodiments, the mammal is a human. A therapeutically effective amount can vary widely depending on the severity of the disease, the age and relative health of the subject, the potency of the therapeutic agent used and other factors. The therapeutic agents can be used singly or in combination with one or more therapeutic agents as components of mixtures.

The pharmaceutical formulations described herein are administered to a subject by appropriate administration routes, including but not limited to, oral, parenteral (e.g., intravenous, subcutaneous, intramuscular), intranasal, buccal, topical, or transdermal administration routes. The pharmaceutical formulations described herein include, but are not limited to, aqueous liquid dispersions, self-emulsifying dispersions, solid solutions, liposomal dispersions, aerosols, solid dosage forms, powders, immediate release formulations, controlled release formulations, fast melt formulations, tablets, capsules, pills, delayed release formulations, extended release formulations, pulsatile release formulations, multiparticulate formulations, and mixed immediate and controlled release formulations.

Pharmaceutical compositions including a therapeutic agent, e.g., inhibitor of anti-CD30L, are manufactured in a conventional manner, such as, by way of example only, by means of conventional mixing, dissolving, granulating, dragee-making, levigating, emulsifying, encapsulating, entrapping or compression processes. Optionally, the compositions include another therapeutic agent, e.g., one as discussed herein.

The pharmaceutical compositions may include at least a therapeutic agent, e.g., inhibitor of anti-CD30L, as an active ingredient in free-acid or free-base form, or in a pharmaceutically acceptable salt form. In addition, the methods and pharmaceutical compositions described herein include the use of N-oxides (if appropriate), crystalline forms, amorphous phases, as well as active metabolites of these compounds having the same type of activity. In some embodiments, therapeutic agents exist in unsolvated form or in solvated forms with pharmaceutically acceptable solvents such as water, ethanol, and the like. The solvated forms of the therapeutic agents are also considered to be disclosed herein.

In some embodiments, a therapeutic agent exists as a tautomer. All tautomers are included within the scope of the agents presented herein. As such, it is to be understood that a therapeutic agent or a salt thereof may exhibit the phenomenon of tautomerism whereby two chemical compounds that are capable of facile interconversion by exchanging a hydrogen atom between two atoms, to either of which it forms a covalent bond. Since the tautomeric compounds exist in mobile equilibrium with each other they may be regarded as different isomeric forms of the same compound.

In some embodiments, a therapeutic agent exists as an enantiomer, diastereomer, or other steroisomeric form. The agents disclosed herein include all enantiomeric, diastereomeric, and epimeric forms as well as mixtures thereof.

In some embodiments, therapeutic agents described herein may be prepared as prodrugs. A "prodrug" refers to an agent that is converted into the parent drug in vivo. Prodrugs are often useful because, in some situations, they may be easier to administer than the parent drug. They may, for instance, be bioavailable by oral administration whereas the parent is not. The prodrug may also have improved solubility in pharmaceutical compositions over the parent drug. An example, without limitation, of a prodrug would be a therapeutic agent described herein, which is administered as an ester (the "prodrug") to facilitate transmittal across a cell membrane where water solubility is detrimental to mobility but which then is metabolically hydrolyzed to the carboxylic acid, the active entity, once inside the cell where water-solubility is beneficial. A further example of a prodrug might be a short peptide (polyaminoacid) bonded to an acid group where the peptide is metabolized to reveal the active moiety. In certain embodiments, upon in vivo administration, a prodrug is chemically converted to the biologically, pharmaceutically or therapeutically active form of the therapeutic agent. In certain embodiments, a prodrug is enzymatically metabolized by one or more steps or processes to the biologically, pharmaceutically or therapeutically active form of the therapeutic agent.

Prodrug forms of the therapeutic agents, wherein the prodrug is metabolized in vivo to produce an agent as set forth herein are included within the scope of the claims. Prodrug forms of the herein described therapeutic agents, wherein the prodrug is metabolized in vivo to produce an agent as set forth herein are included within the scope of the claims. In some cases, some of the therapeutic agents described herein may be a prodrug for another derivative or active compound. In some embodiments described herein, hydrazones are metabolized in vivo to produce a therapeutic agent.

In certain embodiments, compositions provided herein include one or more preservatives to inhibit microbial activity. Suitable preservatives include mercury-containing substances such as merfen and thiomersal; stabilized chlorine dioxide; and quaternary ammonium compounds such as benzalkonium chloride, cetyltrimethylammonium bromide and cetylpyridinium chloride.

In some embodiments, formulations described herein benefit from antioxidants, metal chelating agents, thiol containing compounds and other general stabilizing agents. Examples of such stabilizing agents, include, but are not limited to: (a) about 0.5% to about 2% w/v glycerol, (b) about 0.1% to about 1% w/v methionine, (c) about 0.1% to about 2% w/v monothioglycerol, (d) about 1 mM to about 10 mM EDTA, (e) about 0.01% to about 2% w/v ascorbic acid, (f) 0.003% to about 0.02% w/v polysorbate 80, (g) 0.001% to about 0.05% w/v. polysorbate 20, (h) arginine, (i) heparin, (j) dextran sulfate, (k) cyclodextrins, (l) pentosan polysulfate and other heparinoids, (m) divalent cations such as magnesium and zinc; or (n) combinations thereof.

The pharmaceutical compositions described herein, which include a therapeutic agent such an inhibitor of CD30L are formulated into any suitable dosage form, including but not limited to, aqueous oral dispersions, liquids, gels, syrups, elixirs, slurries, suspensions, solid oral dosage forms, aerosols, controlled release formulations, fast melt formulations, effervescent formulations, lyophilized formulations, tablets, powders, pills, dragees, capsules, delayed release formulations, extended release formulations, pulsatile release formulations, multiparticulate formulations, and mixed immediate release and controlled release formulations. In one aspect, a therapeutic agent as discussed herein, e.g., an inhibitor of CD30L is formulated into a pharmaceutical composition suitable for intramuscular, subcutaneous, or intravenous injection. In one aspect, formulations suitable for intramuscular, subcutaneous, or intravenous injection include physiologically acceptable sterile aqueous or non-aqueous solutions, dispersions, suspensions or emulsions, and sterile powders for reconstitution into sterile injectable solutions or dispersions. Examples of suitable aqueous and non-aqueous carriers, diluents, solvents, or vehicles include water, ethanol, polyols (propyleneglycol, polyethylene-glycol, glycerol, cremophor and the like), suitable mixtures thereof, vegetable oils (such as olive oil) and injectable organic esters such as ethyl oleate. Proper fluidity can be maintained, for example, by the use of a coating such as lecithin, by the maintenance of the required particle size in the case of dispersions, and by the use of surfactants. In some embodiments, formulations suitable for subcutaneous injection also contain additives such as preserving, wetting, emulsifying, and dispensing agents. Prevention of the growth of microorganisms can be ensured by various antibacterial and antifungal agents, such as parabens, chlorobutanol, phenol, sorbic acid, and the like. In some cases it is desirable to include isotonic agents, such as sugars, sodium chloride, and the like. Prolonged absorption of the injectable pharmaceutical form can be brought about by the use of agents delaying absorption, such as aluminum monostearate and gelatin.

For intravenous injections or drips or infusions, a therapeutic agent described herein is formulated in aqueous solutions, preferably in physiologically compatible buffers such as Hank's solution, Ringer's solution, or physiological saline buffer. For transmucosal administration, penetrants appropriate to the barrier to be permeated are used in the formulation. Such penetrants are generally known in the art. For other parenteral injections, appropriate formulations include aqueous or nonaqueous solutions, preferably with physiologically compatible buffers or excipients. Such excipients are known.

Parenteral injections may involve bolus injection or continuous infusion. Formulations for injection may be presented in unit dosage form, e.g., in ampoules or in multi-dose containers, with an added preservative. The pharmaceutical composition described herein may be in a form suitable for parenteral injection as a sterile suspensions, solutions or emulsions in oily or aqueous vehicles, and may contain formulatory agents such as suspending, stabilizing and/or dispersing agents. In one aspect, the active ingredient is in powder form for constitution with a suitable vehicle, e.g., sterile pyrogen-free water, before use.

For administration by inhalation, a therapeutic agent is formulated for use as an aerosol, a mist or a powder. Pharmaceutical compositions described herein are conveniently delivered in the form of an aerosol spray presentation from pressurized packs or a nebuliser, with the use of a suitable propellant, e.g., dichlorodifluoromethane, trichlorofluoromethane, dichlorotetrafluoroethane, carbon dioxide or other suitable gas. In the case of a pressurized aerosol, the dosage unit may be determined by providing a valve to deliver a metered amount. Capsules and cartridges of, such as, by way of example only, gelatin for use in an inhaler or insufflator may be formulated containing a powder mix of the therapeutic agent described herein and a suitable powder base such as lactose or starch.

Representative intranasal formulations are described in, for example, U.S. Pat. Nos. 4,476,116, 5,116,817 and 6,391,452. Formulations that include a therapeutic agent are prepared as solutions in saline, employing benzyl alcohol or other suitable preservatives, fluorocarbons, and/or other solubilizing or dispersing agents known in the art. See, for example, Ansel, H. C. et al., Pharmaceutical Dosage Forms and Drug Delivery Systems, Sixth Ed. (1995). Preferably these compositions and formulations are prepared with suitable nontoxic pharmaceutically acceptable ingredients. These ingredients are known to those skilled in the preparation of nasal dosage forms and some of these can be found in REMINGTON: THE SCIENCE AND PRACTICE OF PHARMACY, 21st edition, 2005. The choice of suitable carriers is dependent upon the exact nature of the nasal dosage form desired, e.g., solutions, suspensions, ointments, or gels. Nasal dosage forms generally contain large amounts of water in addition to the active ingredient. Minor amounts of other ingredients such as pH adjusters, emulsifiers or dispersing agents, preservatives, surfactants, gelling agents, or buffering and other stabilizing and solubilizing agents are optionally present. Preferably, the nasal dosage form should be isotonic with nasal secretions.

Pharmaceutical preparations for oral use are obtained by mixing one or more solid excipient with one or more of the therapeutic agents described herein, optionally grinding the resulting mixture, and processing the mixture of granules, after adding suitable auxiliaries, if desired, to obtain tablets or dragee cores. Suitable excipients include, for example, fillers such as sugars, including lactose, sucrose, mannitol, or sorbitol; cellulose preparations such as, for example, maize starch, wheat starch, rice starch, potato starch, gelatin, gum tragacanth, methylcellulose, microcrystalline cellulose, hydroxypropylmethylcellulose, sodium carboxymethylcellulose; or others such as: polyvinylpyrrolidone (PVP or povidone) or calcium phosphate. If desired, disintegrating agents are added, such as the cross-linked croscarmellose sodium, polyvinylpyrrolidone, agar, or alginic acid or a salt thereof such as sodium alginate. In some embodiments, dyestuffs or pigments are added to the tablets or dragee coatings for identification or to characterize different combinations of active therapeutic agent doses.

In some embodiments, pharmaceutical formulations of a therapeutic agent are in the form of a capsules, including push-fit capsules made of gelatin, as well as soft, sealed capsules made of gelatin and a plasticizer, such as glycerol or sorbitol. The push-fit capsules contain the active ingredients in admixture with filler such as lactose, binders such as starches, and/or lubricants such as talc or magnesium stearate and, optionally, stabilizers. In soft capsules, the active therapeutic agent is dissolved or suspended in suitable liquids, such as fatty oils, liquid paraffin, or liquid polyethylene glycols. In some embodiments, stabilizers are added. A capsule may be prepared, for example, by placing the bulk blend of the formulation of the therapeutic agent inside of a capsule. In some embodiments, the formulations (non-aqueous suspensions and solutions) are placed in a soft gelatin capsule. In other embodiments, the formulations are placed in standard gelatin capsules or non-gelatin capsules such as capsules comprising HPMC. In other embodiments, the formulation is placed in a sprinkle capsule, wherein the capsule is swallowed whole or the capsule is opened and the contents sprinkled on food prior to eating.

All formulations for oral administration are in dosages suitable for such administration. In one aspect, solid oral dosage forms are prepared by mixing a therapeutic agent with one or more of the following: antioxidants, flavoring agents, and carrier materials such as binders, suspending agents, disintegration agents, filling agents, surfactants, solubilizers, stabilizers, lubricants, wetting agents, and diluents. In some embodiments, the solid dosage forms disclosed herein are in the form of a tablet, (including a suspension tablet, a fast-melt tablet, a bite-disintegration tablet, a rapid-disintegration tablet, an effervescent tablet, or a caplet), a pill, a powder, a capsule, solid dispersion, solid solution, bioerodible dosage form, controlled release formulations, pulsatile release dosage forms, multiparticulate dosage forms, beads, pellets, granules. In other embodiments, the pharmaceutical formulation is in the form of a powder. Compressed tablets are solid dosage forms prepared by compacting the bulk blend of the formulations described above. In various embodiments, tablets will include one or more flavoring agents. In other embodiments, the tablets will include a film surrounding the final compressed tablet. In some embodiments, the film coating can provide a delayed release of a therapeutic agent from the formulation. In other embodiments, the film coating aids in patient compliance (e.g., Opadry® coatings or sugar coating). Film coatings including Opadry® typically range from about 1% to about 3% of the tablet weight. In some embodiments, solid dosage forms, e.g., tablets, effervescent tablets, and capsules, are prepared by mixing particles of a therapeutic agent with one or more pharmaceutical excipients to form a bulk blend composition. The bulk blend is readily subdivided into equally effective unit dosage forms, such as tablets, pills, and capsules. In some embodiments, the individual unit dosages include film coatings. These formulations are manufactured by conventional formulation techniques.

In another aspect, dosage forms include microencapsulated formulations. In some embodiments, one or more other compatible materials are present in the microencapsulation material. Exemplary materials include, but are not limited to, pH modifiers, erosion facilitators, anti-foaming agents, antioxidants, flavoring agents, and carrier materials such as binders, suspending agents, disintegration agents, filling agents, surfactants, solubilizers, stabilizers, lubricants, wetting agents, and diluents. Exemplary useful microencapsulation materials include, but are not limited to, hydroxypropyl cellulose ethers (HPC) such as Klucel® or Nisso HPC, low-substituted hydroxypropyl cellulose ethers (L-HPC), hydroxypropyl methyl cellulose ethers (HPMC) such as Seppifilm-LC, Pharmacoat®, Metolose SR, Methocel®-E, Opadry YS, PrimaFlo, Benecel MP824, and Benecel MP843, methylcellulose polymers such as Methocel®-A, hydroxypropylmethylcellulose acetate stearate Aqoat (HF-LS, HF-LG, HF-MS) and Metolose®, Ethylcelluloses (EC) and mixtures thereof such as E461, Ethocel®, Aqualon®-EC, Surelease®, Polyvinyl alcohol (PVA) such as Opadry AMB, hydroxyethylcelluloses such as Natrosol®, carboxymethylcelluloses and salts of carboxymethylcelluloses (CMC) such as Aqualon®-CMC, polyvinyl alcohol and polyethylene glycol co-polymers such as Kollicoat IR®, monoglycerides (Myverol), triglycerides (KLX), polyethylene glycols, modified food starch, acrylic polymers and mixtures of acrylic polymers with cellulose ethers such as Eudragit® EPO, Eudragit® L30D-55, Eudragit® FS 30D Eudragit® L100-55, Eudragit® L100, Eudragit® S100, Eudragit® RD100, Eudragit® E100, Eudragit® L12.5, Eudragit® S12.5, Eudragit® NE30D, and Eudragit® NE 40D, cellulose acetate phthalate, sepifilms such as mixtures of HPMC and stearic acid, cyclodextrins, and mixtures of these materials.

Liquid formulation dosage forms for oral administration are optionally aqueous suspensions selected from the group including, but not limited to, pharmaceutically acceptable aqueous oral dispersions, emulsions, solutions, elixirs, gels, and syrups. See, e.g., Singh et al., Encyclopedia of Pharmaceutical Technology, 2nd Ed., pp. 754-757 (2002). In addition to therapeutic agent the liquid dosage forms optionally include additives, such as: (a) disintegrating agents; (b) dispersing agents; (c) wetting agents; (d) at least one preservative, (e) viscosity enhancing agents, (f) at least one sweetening agent, and (g) at least one flavoring agent. In some embodiments, the aqueous dispersions further includes a crystal-forming inhibitor.

In some embodiments, the pharmaceutical formulations described herein are self-emulsifying drug delivery systems (SEDDS). Emulsions are dispersions of one immiscible phase in another, usually in the form of droplets. Generally, emulsions are created by vigorous mechanical dispersion. SEDDS, as opposed to emulsions or microemulsions, spontaneously form emulsions when added to an excess of water without any external mechanical dispersion or agitation. An advantage of SEDDS is that only gentle mixing is required to distribute the droplets throughout the solution. Additionally, water or the aqueous phase is optionally added just prior to administration, which ensures stability of an unstable or hydrophobic active ingredient. Thus, the SEDDS provides an effective delivery system for oral and parenteral delivery of hydrophobic active ingredients. In some embodiments, SEDDS provides improvements in the bioavailability of hydrophobic active ingredients. Methods of producing self-emulsifying dosage forms include, but are not limited to, for example, U.S. Pat. Nos. 5,858,401, 6,667,048, and 6,960,563.

Buccal formulations that include a therapeutic agent are administered using a variety of formulations known in the art. For example, such formulations include, but are not limited to, U.S. Pat. Nos. 4,229,447, 4,596,795, 4,755,386, and 5,739,136. In addition, the buccal dosage forms described herein can further include a bioerodible (hydrolysable) polymeric carrier that also serves to adhere the dosage form to the buccal mucosa. For buccal or sublingual administration, the compositions may take the form of tablets, lozenges, or gels formulated in a conventional manner.

For intravenous injections, a therapeutic agent is optionally formulated in aqueous solutions, preferably in physiologically compatible buffers such as Hank's solution, Ringer's solution, or physiological saline buffer. For transmucosal administration, penetrants appropriate to the barrier to be permeated are used in the formulation. For other parenteral injections, appropriate formulations include aqueous or nonaqueous solutions, preferably with physiologically compatible buffers or excipients.

Parenteral injections optionally involve bolus injection or continuous infusion. Formulations for injection are optionally presented in unit dosage form, e.g., in ampoules or in multi dose containers, with an added preservative. In some embodiments, a pharmaceutical composition described herein is in a form suitable for parenteral injection as a sterile suspensions, solutions or emulsions in oily or aqueous vehicles, and contain formulatory agents such as suspending, stabilizing and/or dispersing agents. Pharmaceutical formulations for parenteral administration include aqueous solutions of an agent that modulates the activity of a carotid body in water soluble form. Additionally, suspensions of an agent that modulates the activity of a carotid body are optionally prepared as appropriate, e.g., oily injection suspensions.

Conventional formulation techniques include, e.g., one or a combination of methods: (1) dry mixing, (2) direct compression, (3) milling, (4) dry or non-aqueous granulation, (5) wet granulation, or (6) fusion. Other methods include, e.g., spray drying, pan coating, melt granulation, granulation, fluidized bed spray drying or coating (e.g., wurster coating), tangential coating, top spraying, tableting, extruding and the like.

Suitable carriers for use in the solid dosage forms described herein include, but are not limited to, acacia, gelatin, colloidal silicon dioxide, calcium glycerophosphate, calcium lactate, maltodextrin, glycerine, magnesium silicate, sodium caseinate, soy lecithin, sodium chloride, tricalcium phosphate, dipotassium phosphate, sodium stearoyl lactylate, carrageenan, monoglyceride, diglyceride, pregelatinized starch, hydroxypropylmethylcellulose, hydroxypropylmethylcellulose acetate stearate, sucrose, microcrystalline cellulose, lactose, mannitol and the like.

Suitable filling agents for use in the solid dosage forms described herein include, but are not limited to, lactose, calcium carbonate, calcium phosphate, dibasic calcium phosphate, calcium sulfate, microcrystalline cellulose, cellulose powder, dextrose, dextrates, dextran, starches, pregelatinized starch, hydroxypropylmethycellulose (HPMC), hydroxypropylmethylcellulose phthalate, hydroxypropylmethylcellulose acetate stearate (HPMCAS), sucrose, xylitol, lactitol, mannitol, sorbitol, sodium chloride, polyethylene glycol, and the like.

Suitable disintegrants for use in the solid dosage forms described herein include, but are not limited to, natural starch such as corn starch or potato starch, a pregelatinized starch, or sodium starch glycolate, a cellulose such as methylrstalline cellulose, methylcellulose, microcrystalline cellulose, croscarmellose, or a cross-linked cellulose, such as cross-linked sodium carboxymethylcellulose, cross-linked carboxymethylcellulose, or cross-linked croscarmellose, a cross-linked starch such as sodium starch glycolate, a cross-linked polymer such as crospovidone, a cross-linked polyvinylpyrrolidone, alginate such as alginic acid or a salt of alginic acid such as sodium alginate, a gum such as agar, guar, locust bean, Karaya, pectin, or tragacanth, sodium starch glycolate, bentonite, sodium lauryl sulfate, sodium lauryl sulfate in combination starch, and the like.

Binders impart cohesiveness to solid oral dosage form formulations: for powder filled capsule formulation, they aid in plug formation that can be filled into soft or hard shell capsules and for tablet formulation, they ensure the tablet remaining intact after compression and help assure blend uniformity prior to a compression or fill step. Materials suitable for use as binders in the solid dosage forms described herein include, but are not limited to, carboxymethylcellulose, methylcellulose, hydroxypropylmethylcellulose, hydroxypropylmethylcellulose acetate stearate, hydroxyethylcellulose, hydroxypropylcellulose, ethylcellulose, and microcrystalline cellulose, microcrystalline dextrose, amylose, magnesium aluminum silicate, polysaccharide acids, bentonites, gelatin, polyvinylpyrrolidone/vinyl acetate copolymer, crospovidone, povidone, starch, pregelatinized starch, tragacanth, dextrin, a sugar, such as sucrose, glucose, dextrose, molasses, mannitol, sorbitol, xylitol, lactose, a natural or synthetic gum such as acacia, tragacanth, ghatti gum, mucilage of isapol husks, starch, polyvinylpyrrolidone, larch arabogalactan, polyethylene glycol, waxes, sodium alginate, and the like.

In general, binder levels of 20-70% are used in powder-filled gelatin capsule formulations. Binder usage level in tablet formulations varies whether direct compression, wet granulation, roller compaction, or usage of other excipients such as fillers which itself can act as moderate binder. Binder levels of up to 70% in tablet formulations is common.

Suitable lubricants or glidants for use in the solid dosage forms described herein include, but are not limited to, stearic acid, calcium hydroxide, talc, corn starch, sodium stearyl fumerate, alkali-metal and alkaline earth metal salts, such as aluminum, calcium, magnesium, zinc, stearic acid, sodium stearates, magnesium stearate, zinc stearate, waxes, Stearowet®, boric acid, sodium benzoate, sodium acetate, sodium chloride, leucine, a polyethylene glycol or a methoxypolyethylene glycol such as Carbowax™ PEG 4000, PEG 5000, PEG 6000, propylene glycol, sodium oleate, glyceryl behenate, glyceryl palmitostearate, glyceryl benzoate, magnesium or sodium lauryl sulfate, and the like.

Suitable diluents for use in the solid dosage forms described herein include, but are not limited to, sugars (including lactose, sucrose, and dextrose), polysaccharides (including dextrates and maltodextrin), polyols (including mannitol, xylitol, and sorbitol), cyclodextrins and the like.

Suitable wetting agents for use in the solid dosage forms described herein include, for example, oleic acid, glyceryl monostearate, sorbitan monooleate, sorbitan monolaurate, triethanolamine oleate, polyoxyethylene sorbitan monooleate, polyoxyethylene sorbitan monolaurate, quaternary ammonium compounds (e.g., Polyquat 10t), sodium oleate, sodium lauryl sulfate, magnesium stearate, sodium docusate, triacetin, vitamin E TPGS and the like.

Suitable surfactants for use in the solid dosage forms described herein include, for example, sodium lauryl sulfate, sorbitan monooleate, polyoxyethylene sorbitan monooleate, polysorbates, polaxomers, bile salts, glyceryl monostearate, copolymers of ethylene oxide and propylene oxide, e.g., Pluronic® (BASF), and the like.

Suitable suspending agents for use in the solid dosage forms described here include, but are not limited to, polyvinylpyrrolidone, e.g., polyvinylpyrrolidone K12, polyvinylpyrrolidone K17, polyvinylpyrrolidone K25, or polyvinylpyrrolidone K30, polyethylene glycol, e.g., the polyethylene glycol can have a molecular weight of about 300 to about 6000, or about 3350 to about 4000, or about 7000 to about 5400, vinyl pyrrolidone/vinyl acetate copolymer (S630), sodium carboxymethylcellulose, methylcellulose, hydroxy-propylmethylcellulose, polysorbate-80, hydroxyethylcellulose, sodium alginate, gums, such as, e.g., gum tragacanth and gum acacia, guar gum, xanthans, including xanthan gum, sugars, cellulosics, such as, e.g., sodium carboxymethylcellulose, methylcellulose, sodium carboxymethylcellulose, hydroxypropylmethylcellulose, hydroxyethylcellulose, polysorbate-80, sodium alginate, polyethoxylated sorbitan monolaurate, polyethoxylated sorbitan monolaurate, povidone and the like.

Suitable antioxidants for use in the solid dosage forms described herein include, for example, e.g., butylated hydroxytoluene (BHT), sodium ascorbate, and tocopherol.

It should be appreciated that there is considerable overlap between additives used in the solid dosage forms described herein. Thus, the above-listed additives should be taken as merely exemplary, and not limiting, of the types of additives that can be included in solid dosage forms of the pharmaceutical compositions described herein. The amounts of such additives can be readily determined by one skilled in the art, according to the particular properties desired.

In various embodiments, the particles of a therapeutic agents and one or more excipients are dry blended and compressed into a mass, such as a tablet, having a hardness sufficient to provide a pharmaceutical composition that substantially disintegrates within less than about 30 minutes, less than about 35 minutes, less than about 40 minutes, less than about 45 minutes, less than about 50 minutes, less than about 55 minutes, or less than about 60 minutes, after oral administration, thereby releasing the formulation into the gastrointestinal fluid.

In other embodiments, a powder including a therapeutic agent is formulated to include one or more pharmaceutical excipients and flavors. Such a powder is prepared, for example, by mixing the therapeutic agent and optional pharmaceutical excipients to form a bulk blend composition. Additional embodiments also include a suspending agent and/or a wetting agent. This bulk blend is uniformly subdivided into unit dosage packaging or multi-dosage packaging units.

In still other embodiments, effervescent powders are also prepared. Effervescent salts have been used to disperse medicines in water for oral administration.

In some embodiments, the pharmaceutical dosage forms are formulated to provide a controlled release of a therapeutic agent. Controlled release refers to the release of the therapeutic agent from a dosage form in which it is incorporated according to a desired profile over an extended period of time. Controlled release profiles include, for example, sustained release, prolonged release, pulsatile release, and delayed release profiles. In contrast to immediate release compositions, controlled release compositions allow delivery of an agent to a subject over an extended period of time according to a predetermined profile. Such release rates can provide therapeutically effective levels of agent for an extended period of time and thereby provide a longer period of pharmacologic response while minimizing side effects as compared to conventional rapid release dosage forms. Such longer periods of response provide for many inherent benefits that are not achieved with the corresponding short acting, immediate release preparations.

In some embodiments, the solid dosage forms described herein are formulated as enteric coated delayed release oral dosage forms, i.e., as an oral dosage form of a pharmaceutical composition as described herein which utilizes an enteric coating to affect release in the small intestine or large intestine. In one aspect, the enteric coated dosage form is a compressed or molded or extruded tablet/mold (coated or uncoated) containing granules, powder, pellets, beads or particles of the active ingredient and/or other composition components, which are themselves coated or uncoated. In one aspect, the enteric coated oral dosage form is in the form of a capsule containing pellets, beads or granules, which include a therapeutic agent that are coated or uncoated.

Any coatings should be applied to a sufficient thickness such that the entire coating does not dissolve in the gastrointestinal fluids at pH below about 5, but does dissolve at pH about 5 and above. Coatings are typically selected from any of the following: Shellac—this coating dissolves in media of pH >7; Acrylic polymers—examples of suitable acrylic polymers include methacrylic acid copolymers and ammonium methacrylate copolymers. The Eudragit series E, L, S, RL, RS and NE (Rohm Pharma) are available as solubilized in organic solvent, aqueous dispersion, or dry powders. The Eudragit series RL, NE, and RS are insoluble in the gastrointestinal tract but are permeable and are used primarily for colonic targeting. The Eudragit series E dissolve in the stomach. The Eudragit series L, L-30D and S are insoluble in stomach and dissolve in the intestine; Poly Vinyl Acetate Phthalate (PVAP)—PVAP dissolves in pH >5, and it is much less permeable to water vapor and gastric fluids. Conventional coating techniques such as spray or pan coating are employed to apply coatings. The coating thickness must be sufficient to ensure that the oral dosage form remains intact until the desired site of topical delivery in the intestinal tract is reached.

In other embodiments, the formulations described herein are delivered using a pulsatile dosage form. A pulsatile dosage form is capable of providing one or more immediate release pulses at predetermined time points after a controlled lag time or at specific sites. Exemplary pulsatile dosage forms and methods of their manufacture are disclosed in U.S. Pat. Nos. 5,011,692, 5,017,381, 5,229,135, 5,840,329 and 5,837,284. In one embodiment, the pulsatile dosage form includes at least two groups of particles, (i.e. multiparticulate) each containing the formulation described herein. The first group of particles provides a substantially immediate dose of a therapeutic agent upon ingestion by a mammal. The first group of particles can be either uncoated or include a coating and/or sealant. In one aspect, the second group of particles comprises coated particles. The coating on the second group of particles provides a delay of from about 2 hours to about 7 hours following ingestion before release of the second dose. Suitable coatings for pharmaceutical compositions are described herein or known in the art.

In some embodiments, pharmaceutical formulations are provided that include particles of a therapeutic agent and at least one dispersing agent or suspending agent for oral administration to a subject. The formulations may be a powder and/or granules for suspension, and upon admixture with water, a substantially uniform suspension is obtained.

In some embodiments, particles formulated for controlled release are incorporated in a gel or a patch or a wound dressing.

In one aspect, liquid formulation dosage forms for oral administration and/or for topical administration as a wash are in the form of aqueous suspensions selected from the group including, but not limited to, pharmaceutically acceptable aqueous oral dispersions, emulsions, solutions, elixirs, gels, and syrups. See, e.g., Singh et al., Encyclopedia of Pharmaceutical Technology, 2nd Ed., pp. 754-757 (2002). In addition to the particles of a therapeutic agent, the liquid dosage forms include additives, such as: (a) disintegrating agents; (b) dispersing agents; (c) wetting agents; (d) at least one preservative, (e) viscosity enhancing agents, (f) at least one sweetening agent, and (g) at least one flavoring agent. In some embodiments, the aqueous dispersions can further include a crystalline inhibitor.

In some embodiments, the liquid formulations also include inert diluents commonly used in the art, such as water or other solvents, solubilizing agents, and emulsifiers. Exemplary emulsifiers are ethyl alcohol, isopropyl alcohol, ethyl carbonate, ethyl acetate, benzyl alcohol, benzyl benzoate, propyleneglycol, 1,3-butyleneglycol, dimethylformamide, sodium lauryl sulfate, sodium doccusate, cholesterol, cholesterol esters, taurocholic acid, phosphotidylcholine, oils, such as cottonseed oil, groundnut oil, corn germ oil, olive oil, castor oil, and sesame oil, glycerol, tetrahydrofurfuryl alcohol, polyethylene glycols, fatty acid esters of sorbitan, or mixtures of these substances, and the like.

Furthermore, pharmaceutical compositions optionally include one or more pH adjusting agents or buffering agents, including acids such as acetic, boric, citric, lactic, phosphoric and hydrochloric acids; bases such as sodium hydroxide, sodium phosphate, sodium borate, sodium citrate, sodium acetate, sodium lactate and tris-hydroxymethylaminomethane; and buffers such as citrate/dextrose, sodium bicarbonate and ammonium chloride. Such acids, bases and buffers are included in an amount required to maintain pH of the composition in an acceptable range.

Additionally, pharmaceutical compositions optionally include one or more salts in an amount required to bring osmolality of the composition into an acceptable range. Such salts include those having sodium, potassium or ammonium cations and chloride, citrate, ascorbate, borate, phosphate, bicarbonate, sulfate, thiosulfate or bisulfite anions; suitable salts include sodium chloride, potassium chloride, sodium thiosulfate, sodium bisulfite and ammonium sulfate.

Other pharmaceutical compositions optionally include one or more preservatives to inhibit microbial activity. Suitable preservatives include mercury-containing substances such as merfen and thiomersal; stabilized chlorine dioxide; and quaternary ammonium compounds such as benzalkonium chloride, cetyltrimethylammonium bromide and cetylpyridinium chloride.

In one embodiment, the aqueous suspensions and dispersions described herein remain in a homogenous state, as defined in The USP Pharmacists' Pharmacopeia (2005 edition, chapter 905), for at least 4 hours. In one embodiment, an aqueous suspension is re-suspended into a homogenous suspension by physical agitation lasting less than 1 minute. In still another embodiment, no agitation is necessary to maintain a homogeneous aqueous dispersion.

Examples of disintegrating agents for use in the aqueous suspensions and dispersions include, but are not limited to, a starch, e.g., a natural starch such as corn starch or potato starch, a pregelatinized starch, or sodium starch glycolate; a cellulose such as methylrystalline cellulose, methylcellulose, croscarmellose, or a cross-linked cellulose, such as cross-linked sodium carboxymethylcellulose, cross-linked carboxymethylcellulose, or cross-linked croscarmellose; a cross-linked starch such as sodium starch glycolate; a cross-linked polymer such as crospovidone; a cross-linked polyvinylpyrrolidone; alginate such as alginic acid or a salt of alginic acid such as sodium alginate; a gum such as agar, guar, locust bean, Karaya, pectin, or tragacanth; sodium starch glycolate; bentonite; a natural sponge; a surfactant; a resin such as a cation-exchange resin; citrus pulp; sodium lauryl sulfate; sodium lauryl sulfate in combination starch; and the like.

In some embodiments, the dispersing agents suitable for the aqueous suspensions and dispersions described herein include, for example, hydrophilic polymers, electrolytes, Tween® 60 or 80, PEG, polyvinylpyrrolidone, and the carbohydrate-based dispersing agents such as, for example, hydroxypropylcellulose and hydroxypropyl cellulose ethers, hydroxypropyl methylcellulose and hydroxypropyl methylcellulose ethers, carboxymethylcellulose sodium, methylcellulose, hydroxyethylcellulose, hydroxypropylmethyl-cellulose phthalate, hydroxypropylmethyl-cellulose acetate stearate, noncrystalline cellulose, magnesium aluminum silicate, triethanolamine, polyvinyl alcohol (PVA), polyvinylpyrrolidone/vinyl acetate copolymer, 4-(1,1,3,3-tetramethylbutyl)-phenol polymer with ethylene oxide and formaldehyde (also known as tyloxapol), poloxamers; and poloxamines. In other embodiments, the dispersing agent is selected from a group not comprising one of the following agents: hydrophilic polymers; electrolytes; Tween® 60 or 80; PEG; polyvinylpyrrolidone (PVP); hydroxypropylcellulose and hydroxypropyl cellulose ethers; hydroxypropyl methylcellulose and hydroxypropyl methylcellulose ethers; carboxymethylcellulose sodium; methylcellulose; hydroxyethylcellulose; hydroxypropylmethyl-cellulose phthalate; hydroxypropylmethyl-cellulose acetate stearate; non-crystalline cellulose; magnesium aluminum silicate; triethanolamine; polyvinyl alcohol (PVA); 4-(1,1,3,3-tetramethylbutyl)-phenol polymer with ethylene oxide and formaldehyde; poloxamers; or poloxamines.

Wetting agents suitable for the aqueous suspensions and dispersions described herein include, but are not limited to, cetyl alcohol, glycerol monostearate, polyoxyethylene sorbitan fatty acid esters (e.g., the commercially available Tweens® such as e.g., Tween 20® and Tween 80$^6$, and polyethylene glycols, oleic acid, glyceryl monostearate, sorbitan monooleate, sorbitan monolaurate, triethanolamine oleate, polyoxyethylene sorbitan monooleate, polyoxyethylene sorbitan monolaurate, sodium oleate, sodium lauryl sulfate, sodium docusate, triacetin, vitamin E TPGS, sodium taurocholate, simethicone, phosphotidylcholine and the like.

Suitable preservatives for the aqueous suspensions or dispersions described herein include, for example, potassium sorbate, parabens (e.g., methylparaben and propylparaben), benzoic acid and its salts, other esters of parahydroxybenzoic acid such as butylparaben, alcohols such as ethyl alcohol or benzyl alcohol, phenolic compounds such as phenol, or quaternary compounds such as benzalkonium chloride. Preservatives, as used herein, are incorporated into the dosage form at a concentration sufficient to inhibit microbial growth.

Suitable viscosity enhancing agents for the aqueous suspensions or dispersions described herein include, but are not limited to, methyl cellulose, xanthan gum, carboxymethyl cellulose, hydroxypropyl cellulose, hydroxypropylmethyl cellulose, Plasdon® S-630, carbomer, polyvinyl alcohol, alginates, acacia, chitosans and combinations thereof. The concentration of the viscosity enhancing agent will depend upon the agent selected and the viscosity desired.

Examples of sweetening agents suitable for the aqueous suspensions or dispersions described herein include, for example, acacia syrup, acesulfame K, alitame, aspartame, chocolate, cinnamon, citrus, cocoa, cyclamate, dextrose, fructose, ginger, glycyrrhetinate, glycyrrhiza (licorice) syrup, monoammonium glyrrhizinate (MagnaSweet®), malitol, mannitol, menthol, neohesperidine DC, neotame, Prosweet® Powder, saccharin, sorbitol, stevia, sucralose, sucrose, sodium saccharin, saccharin, aspartame, acesulfame potassium, mannitol, sucralose, tagatose, thaumatin, vanilla, xylitol, or any combination thereof.

In some embodiments, a therapeutic agent is prepared as transdermal dosage form. In some embodiments, the transdermal formulations described herein include at least three components: (1) a therapeutic agent; (2) a penetration enhancer; and (3) an optional aqueous adjuvant. In some embodiments the transdermal formulations include additional components such as, but not limited to, gelling agents, creams and ointment bases, and the like. In some embodiments, the transdermal formulation is presented as a patch or a wound dressing. In some embodiments, the transdermal formulation further include a woven or non-woven backing material to enhance absorption and prevent the removal of the transdermal formulation from the skin. In other embodiments, the transdermal formulations described herein can maintain a saturated or supersaturated state to promote diffusion into the skin.

In one aspect, formulations suitable for transdermal administration of a therapeutic agent described herein employ transdermal delivery devices and transdermal delivery patches and can be lipophilic emulsions or buffered, aqueous solutions, dissolved and/or dispersed in a polymer or an adhesive. In one aspect, such patches are constructed for continuous, pulsatile, or on demand delivery of pharmaceutical agents. Still further, transdermal delivery of the therapeutic agents described herein can be accomplished by means of iontophoretic patches and the like. In one aspect, transdermal patches provide controlled delivery of a therapeutic agent. In one aspect, transdermal devices are in the form of a bandage comprising a backing member, a reservoir containing the therapeutic agent optionally with carriers, optionally a rate controlling barrier to deliver the therapeutic agent to the skin of the host at a controlled and predetermined rate over a prolonged period of time, and means to secure the device to the skin.

In further embodiments, topical formulations include gel formulations (e.g., gel patches which adhere to the skin). In some of such embodiments, a gel composition includes any polymer that forms a gel upon contact with the body (e.g., gel formulations comprising hyaluronic acid, pluronic polymers, poly(lactic-co-glycolic acid (PLGA)-based polymers or the like). In some forms of the compositions, the formulation comprises a low-melting wax such as, but not limited to, a mixture of fatty acid glycerides, optionally in combination with cocoa butter which is first melted. Optionally, the formulations further comprise a moisturizing agent.

In certain embodiments, delivery systems for pharmaceutical therapeutic agents may be employed, such as, for example, liposomes and emulsions. In certain embodiments, compositions provided herein can also include an mucoadhesive polymer, selected from among, for example, carboxymethylcellulose, carbomer (acrylic acid polymer), poly (methylmethacrylate), polyacrylamide, polycarbophil, acrylic acid/butyl acrylate copolymer, sodium alginate and dextran.

In some embodiments, a therapeutic agent described herein may be administered topically and can be formulated into a variety of topically administrable compositions, such as solutions, suspensions, lotions, gels, pastes, medicated sticks, balms, creams or ointments. Such pharmaceutical therapeutic agents can contain solubilizers, stabilizers, tonicity enhancing agents, buffers and preservatives.

Methods of Monitoring Treatment

In certain embodiments, described herein are methods for evaluating an effect of a treatment described herein. In some instances, the treatment comprises administration with an inhibitor of CD30L and optionally, one or more additional therapeutic agents. In some instances, the treatment is monitored by evaluating the quantity of CD30 in the subject prior to and/or after administration of a therapeutic agent, such as an inhibitor of CD30L.

Disclosed herein, in some embodiments, are the following:

1. A method of inhibiting or reducing CD30 ligand activity or expression in a subject having or suspected of having at least one of an inflammatory disease, fibrostenotic disease, and fibrotic disease, the method comprising:
   a) identifying the subject as being a carrier of an "A" allele at nucleobase 501 within rs911605 (SEQ ID NO: 1), or a polymorphism in linkage disequilibrium therewith; and
   b) administering to the subject a therapeutically effective amount of an anti-CD30 ligand antibody, thereby inhibiting or reducing CD30 ligand activity or expression in the subject.
2. The method of embodiment 1, provided that the inflammatory disease comprises Crohn's disease.
3. The method of embodiment 2, provided that the Crohn's disease comprises chronic obstructive Crohn's disease.
4. The method of embodiment 1, provided that the fibrotic disease comprises a disease of the liver.
5. The method of embodiment 4, provided that the fibrotic disease is primary sclerosing cholangitis.
6. The method of any of embodiments 1-5, wherein identifying the subject as being a carrier of an "A" allele at nucleobase 501 within rs911605 (SEQ ID NO: 1) of step (a) comprising:
   a) contacting a sample comprising genetic material from the subject with a nucleic acid sequence capable of hybridizing to at least 10 contiguous nucleobases between nucleobase 400 and nucleobase 600 of SEQ ID NO: 1 under standard hybridization conditions, wherein the at least 10 contiguous nucleobases comprises nucleobase at position 501; and
b) detecting binding between the nucleic acid sequence and the at least 10 contiguous nucleobases between nucleobase 400 and nucleobase 600 of SEQ ID NO: 1.

7. The method of embodiment 6, provided that the standard hybridization conditions comprise an annealing temperature between about 35° C. and about 65° C.

8. The method of embodiment 6 or embodiment 7, provided that the standard hybridization conditions are performed with a TaqMan master mix solution.

9. The method of any of embodiments 6-8, provided that the nucleic acid sequence is conjugated to a detectable molecule.

10. The method of embodiment 9, provided that the detectable molecule comprises a fluorophore.

11. The method of any of embodiments 6-10, provided that the nucleic acid sequence is conjugated to a quencher.

12. The method of any of embodiments 6-11, provided that the sample comprising genetic material from the subject is amplified genetic material obtained from a nucleic acid amplification assay.

13. The method of embodiment 12, provided that the nucleic acid amplification assay comprises amplification of DNA from the subject with a pair of primers capable of amplifying at least 15 contiguous nucleobases within rs911605, wherein one of the nucleobases within rs911605 is at position 501.

14. The method of embodiment 12, provided that the nucleic acid amplification assay comprises amplification of DNA from the subject with a primer pair comprising SEQ ID NOS: 9-10.

15. The method of any of embodiments 1-14, provided that the subject has been determined to be a carrier of the "A" allele by a process comprising DNA sequencing.

16. The method of any of embodiments 1-15, provided that the subject further comprises soluble CD30 at a level greater than a control level derived from a non-diseased individual or population of non-diseased individuals.

17. The method of any of embodiments 1-16, provided that the subject is homozygous for the "A" allele.

18. The method of any of embodiments 1-17, provided that the subject is a carrier of a "G" allele at nucleobase 501 within rs1006026 (SEQ ID NO: 3).

19. The method of embodiment 18, provided that the subject is homozygous for the "G" allele.

20. The method of any of embodiments 1-19, provided that the subject has a genotype comprising at least one SEQ ID NO: 7 and SEQ ID NO: 8.

21. A method of inhibiting or reducing CD30 ligand activity or expression in a subject having or suspected of having at least one of an inflammatory disease, a fibrostenotic disease, and a fibrotic disease, the method comprising:
a) identifying the subject as having a genotype comprising at least one of SEQ ID NO: 5, SEQ ID NO: 6, and a polymorphism in linkage disequilibrium therewith; and
b) administering to the subject a therapeutically effective amount of an anti-CD30 ligand antibody, thereby inhibiting or reducing CD30 ligand activity or expression in the subject.

22. The method of embodiment 21, provided that the inflammatory disease comprises Crohn's disease.

23. The method of embodiment 22, provided that the Crohn's disease comprises chronic obstructive Crohn's disease.

24. The method of embodiment 21, provided that the fibrotic disease comprises a disease of the liver.

25. The method of embodiment 24, provided that the fibrotic disease is primary sclerosing cholangitis.

26. The method of any of embodiments 21-25, wherein identifying the subject as having the genotype comprising at least one of SEQ ID NO: 5 and SEQ ID NO: 6 comprises:
a) contacting a sample comprising genetic material from the subject with a nucleic acid sequence capable of hybridizing to at least one of SEQ ID NO: 5 and SEQ ID NO: 6, respectively, under standard hybridization conditions; and
b) detecting binding between the nucleic acid sequence and the at least one of SEQ ID NO: 5 and SEQ ID NO.

27. The method of embodiment 26, provided that the standard hybridization conditions comprise an annealing temperature between about 35° C. and about 65° C.

28. The method of embodiment 26 or embodiment 27, provided that the standard hybridization conditions are performed with a Tagman master mix solution.

29. The method of any of embodiments 26-28, provided that the nucleic acid sequence is conjugated to a detectable molecule.

30. The method of embodiment 29, provided that the detectable molecule comprises a fluorophore.

31. The method of any of embodiments 26-30, provided that the nucleic acid sequence is conjugated to a quencher.

32. The method of any of embodiments 26-31, provided that the sample comprising genetic material from the subject is amplified genetic material obtained from a nucleic acid amplification assay.

33. The method of embodiment 32, provided that the nucleic acid amplification assay comprises amplification of DNA from the subject with a pair of primers capable of amplifying at least 15 nucleobases within rs911605, wherein the at least 15 nucleobases comprises SEQ ID NO: 5 and/or SEQ ID NO: 6.

34. The method of embodiment 32, provided that the nucleic acid amplification assay comprises amplification of DNA from the subject with a primer pair comprising SEQ ID NOS: 9-10.

35. The method of any of embodiments 21-25, provided that the subject has been determined to have the genotype comprising SEQ ID NO: 5 and/or SEQ ID NO: 6 by DNA sequencing.

36. The method of any of embodiments 21-35, provided that the subject further comprises soluble CD30.

37. The method of any of embodiments 21-36, provided that the subject is a carrier of a "G" allele at nucleobase 501 within rs1006026 (SEQ ID NO: 3).

38. The method of embodiment 37, provided that the subject is homozygous for the "G" allele.

39. The method of any of embodiments 21-36, provided that the subject has a genotype comprising at least one of SEQ ID NO: 7 and SEQ ID NO: 8.

40. A method of characterizing an inflammatory disease, fibrostenotic disease and/or fibrotic disease of a subject, the method comprising: assaying genetic material from the subject to identify the presence or absence of an "A" allele at nucleobase 501 within rs911605.

41. The method of embodiment 40, further comprising assigning a more favorable prognosis to treatment with an inhibitor of anti-CD30 ligand activity or expression when the "A" allele is present.

42. The method of embodiment 40, further comprising assigning a less favorable prognosis to treatment with an inhibitor of anti-CD30 ligand activity or expression when the "A" allele is absent.

43. The method of embodiment 40, further comprising assigning the subject to treatment with an inhibitor of anti-CD30 ligand activity or expression when the "A" allele is present.

44. The method of embodiment 40, further comprising prescribing to the subject an inhibitor of anti-CD30 ligand activity or expression when the "A" allele is present.

45. The method of embodiment 40, further comprising administering to the subject an inhibitor of anti-CD30 ligand activity or expression when the "A" allele is present.

46. The method of any of embodiments 41-45, provided that the inhibitor of anti-CD30 ligand activity or expression is an anti-CD30 ligand antibody or antigen-binding fragment thereof.

47. The method of any of embodiments 40-46, provided that assaying comprises amplifying from the genetic material at least 15 nucleobases within rs911605, wherein one of the nucleobases is at position 501 within rs911605.

48. The method of any of embodiments 40-47, provided that assaying comprises performing a nucleic acid amplification assay comprising contacting the genetic material with a primer pair comprising SEQ ID NOS: 9-10.

49. The method of any of embodiments 40-48, provided that assaying comprises hybridizing to the genetic material a nucleic acid comprising SEQ ID NO: 5 and/or SEQ ID NO: 6.

50. The method of embodiment 49, provided that the nucleic acid sequence is conjugated to a detectable molecule.

51. The method of embodiment 50, provided that the detectable molecule comprises a fluorophore.

52. The method of any of embodiments 49-51, provided that the nucleic acid sequence is conjugated to a quencher.

53. The method of any of embodiments 40-52, provided that assaying comprises DNA sequencing.

54. The method of any of embodiments 40-53, further comprising measuring the level of CD30 in the subject.

55. The method of any of embodiments 40-54, provided that the assaying identifies the presence or absence of a homozygous genotype for the "A" allele at nucleobase 501 within rs911605.

56. The method of any of embodiments 40-55, further comprising assaying the genetic material from the subject to identify the presence of absence of a "G" allele at nucleobase 501 within rs1006026 (SEQ ID NO: 3).

57. The method of embodiment 56, provided that the assaying identifies the presence or absence of a homozygous genotype for the "G" allele at nucleobase 501 within rs1006026.

58. The method of any of embodiments 40-57, further comprising assaying the genetic material from the subject to identify the presence of absence of SEQ ID NO: 7 and/or SEQ ID NO: 8.

59. The method of any of embodiments 40-58, provided that inflammatory disease comprises Crohn's disease.

60. The method of embodiment 59, provided that the Crohn's disease comprises chronic obstructive Crohn's disease.

61. The method of any of embodiments 40-58, provided that the fibrotic disease comprises a disease of the liver.

62. The method of embodiment 61, provided that the fibrotic disease is primary sclerosing cholangitis.

63. A method comprising treating the subject of any of embodiments 40-62 with an inhibitor of CD30 ligand activity or expression, provided that the subject comprises the "A" allele at nucleobase 501 within rs911605.

64. The method of embodiment 63, provided that the inhibitor of CD30 ligand activity comprises an anti-CD30 ligand antibody or antigen binding fragment thereof.

65. A method of characterizing at least one of an inflammatory disease, a fibrostenotic disease, and a fibrotic disease of a subject, the method comprising assaying genetic material from the subject to identify the presence or absence of a genotype comprising at least one of SEQ ID NO: 5 and SEQ ID NO: 6.

66. The method of embodiment 65, further comprising assigning a more favorable prognosis to treatment with an inhibitor of anti-CD30 ligand activity or expression when the genotype is present.

67. The method of embodiment 65, further comprising assigning a less favorable prognosis to with an inhibitor of anti-CD30 ligand activity or expression when the genotype is absent.

68. The method of embodiment 65, further comprising assigning the subject to treatment with an inhibitor of anti-CD30 ligand activity or expression when the genotype is present.

69. The method of embodiment 65, further comprising prescribing to the subject an inhibitor of anti-CD30 ligand activity or expression when the genotype is present.

70. The method of embodiment 65, further comprising administering to the subject an inhibitor of anti-CD30 ligand activity or expression when the genotype is present.

71. The method of any of embodiments 65-70, provided that the inhibitor of anti-CD30 ligand activity or expression is an anti-CD30 ligand antibody or antigen-binding fragment thereof.

72. The method of any of embodiments 65-71, provided that assaying comprises amplifying from the genetic material at least 15 nucleobases within rs911605, wherein one of the nucleobases is at position 501 within rs911605.

73. The method of any of embodiments 65-72, provided that assaying comprises performing a nucleic acid amplification assay comprising contacting the genetic material with a primer pair comprising SEQ ID NOS: 9-10.

74. The method of any of embodiments 65-73, provided that assaying comprises hybridizing to the genetic material a nucleic acid comprising SEQ ID NO: 5 and/or SEQ ID NO: 6.

75. The method of embodiment 74, provided that the nucleic acid sequence is conjugated to a detectable molecule.

76. The method of embodiment 75, provided that the detectable molecule comprises a fluorophore.
77. The method of any of embodiments 74-76, provided that the nucleic acid sequence is conjugated to a quencher.
78. The method of any of embodiments 65-77, provided that assaying comprises DNA sequencing.
79. The method of any of embodiments 65-78, further comprising measuring the level of CD30 in the subject.
80. The method of any of embodiments 65-79, further comprising assaying the genetic material from the subject to identify the presence of absence of a "G" allele at nucleobase 501 within rs1006026 (SEQ ID NO: 3).
81. The method of embodiment 80, provided that the assaying identifies the presence or absence of a homozygous genotype for the "G" allele at nucleobase 501 within rs1006026.
82. The method of any of embodiments 65-81, further comprising assaying the genetic material from the subject to identify the presence of absence of SEQ ID NO: 7 and/or SEQ ID NO: 8.
83. The method of any of embodiments 65-82, further comprising characterizing the at least one of the inflammatory disease, the fibrostenotic disease, and the fibrotic disease as Crohn's disease (CD) provided the genotype is present.
84. The method of embodiment 83, provided that the CD comprises chronic obstructive CD.
85. The method of any of embodiments 65-82, further comprising characterizing the at least one of the inflammatory disease, the fibrostenotic disease, and the fibrotic disease as a disease of the liver, provided the genotype is present.
86. The method of embodiment 85, provided that the fibrotic disease is primary sclerosing cholangitis.
87. A method comprising treating the at least one of the inflammatory disease, the fibrostenotic disease, and the fibrotic disease in the subject of any of embodiments 65-86, the method comprising:
    a) administering to the subject of any of embodiments 65-86 a therapeutically effective amount of an inhibitor of CD30 ligand activity or expression, provided that the subject comprises the genotype comprising at least one of SEQ ID NO: 5 and SEQ ID NO: 6.
88. The method of embodiment 87, provided that the inhibitor of CD30 ligand activity comprises an anti-CD30 ligand antibody or antigen binding fragment thereof.
89. A method for detecting a genotype of interest in a subject comprising at least one of an inflammatory disease, a fibrostenotic disease, and a fibrotic disease, the method comprising:
    (a) contacting genetic material from the subject with a composition sufficiently complementary to and capable of hybridizing to the genotype of interest, the composition comprising:
        (i) a detectably labeled oligonucleotide probe comprising SEQ ID NO: 5,
        (ii) a detectably labeled oligonucleotide probe comprising SEQ ID NO: 6,
        (iii) a detectably labeled oligonucleotide probe comprising SEQ ID NO: 7,
        (iv) a detectably labeled oligonucleotide probe comprising SEQ ID NO: 8,
        (v) a detectably labeled oligonucleotide probe comprising a nucleic acid sequence that differs from a probe selected from the group consisting of (i)-(iv) by up to three nucleobases, provided the detectably labeled oligonucleotide probe of (v) hybridizes to the genotype of interest,
        (vi) a detectably labeled oligonucleotide probe comprising a nucleic acid sequence complementary to a probe selected from the group consisting of (i)-(v), or
        (vii) a combination of probes selected from the group consisting of (i)-(vi),
    (b) detecting the presence or absence of hybridization of the genetic material with the composition using the detectably labeled probe, whereby hybridization of the genetic material with the composition is indicative of the presence of the genotype of interest in the subject.
90. The method of embodiment 89, provided that the presence of the genotype of interest is indicative of the subject comprising elevated levels of CD30 ligand.
91. The method of embodiment 89 or embodiment 90, provided that the inflammatory disease comprises Crohn's disease (CD).
92. The method of embodiment 91, provided that the CD comprises chronic obstructive CD.
93. The method of any of embodiments 89-92, provided that the fibrotic disease comprises a disease of the liver.
94. A method of treating the at least one of an inflammatory disease, a fibrostenotic disease, in the subject of any one of embodiments 85-93, the method comprising:
    a) administering to the subject of any of embodiments 85-93 a therapeutically effective amount of an inhibitor of CD30 ligand activity or expression, provided that the subject comprises the genotype of interest.
95. The method of embodiment 94, provided that the inhibitor of CD30 ligand activity comprises an anti-CD30 ligand antibody or antigen binding fragment thereof.
96. A composition comprising at least 10 but less than 50 contiguous nucleobase residues of SEQ ID NO: 2 or its complement, wherein the contiguous nucleobase residues comprise the nucleobase at position 501 of SEQ ID NO: 2, and wherein the contiguous nucleobase residues are connected to a detectable molecule.
97. The composition of embodiment 96, provided that the detectable molecule is a fluorophore.
98. The composition of embodiment 96 or embodiment 97, provided that the contiguous nucleobase residues are connected to a quencher.
99. The composition of any of embodiments 96-98, wherein the contiguous nucleobase residues comprise SEQ ID NO: 5.
100. The composition of any of embodiments 96-99, wherein the contiguous nucleobase residues comprise SEQ ID NO: 6.
101. A kit comprising the composition of any of embodiments 96-100, and a primer pair having SEQ ID NOS: 9-10.
102. A kit comprising the composition of any of embodiments 96-101, and a primer pair having SEQ ID NOS: 11-12.
103. A kit comprising the composition of any of embodiments 96-102, and a probe comprising SEQ ID NO. 7.
104. A kit comprising the composition of any of embodiments 96-103, and a probe comprising SEQ ID NO. 8.
105. A method comprising contacting DNA from a subject with the composition of any of embodiments 96-100 or the kit of any of embodiments 100-104 under conditions configured to hybridize the composition to the DNA if the DNA comprises a sequence complementary to the composition.
106. A method comprising treating the subject of embodiment 105 with an inhibitor of CD30 ligand activity or expression, provided that the DNA from the subject comprises the sequence complementary to the composition.
107. The method of embodiment 106, provided that the inhibitor of CD30 ligand comprises an anti-CD30 ligand antibody or antigen binding fragment thereof.
108. A method of identifying a risk of developing at least one of an inflammatory disease, a fibrostenotic disease, and a fibrotic disease in a subject, the method comprising:
  a) assaying a sample obtained from the subject to identify the presence of a genotype comprising a polymorphism associated with increased CD30 ligand expression that is in linkage disequilibrium (LD) with at least one of rs1006026 and rs911605; and
  b) identifying the risk of developing the at least one of an inflammatory disease, a fibrostenotic disease, and a fibrotic disease in a subject, provided the presence of the genotype is identified in step (a).
109. A method of characterizing at least one of an inflammatory disease, a fibrostenotic disease, and a fibrotic disease of a subject, the method comprising:
  a) assaying a sample obtained from the subject to identify the presence of a genotype comprising a polymorphism associated with increased CD30 ligand expression that is in linkage disequilibrium (LD) with at least one of rs1006026 and rs911605; and
  b) characterizing the at least one of the inflammatory disease, the fibrostenotic disease, and the fibrotic disease as an inflammatory bowel disease (IBD) or a liver disease, provided the presence of the genotype is identified in step (a).
110. A method of treating at least one of an inflammatory disease, a fibrostenotic disease, and a fibrotic disease in a subject, the method comprising:
  a) assaying a sample obtained from the subject to identify the presence of a genotype comprising a polymorphism associated with increased CD30 ligand expression that is in linkage disequilibrium (LD) with at least one of rs1006026 and rs911605; and
  b) administering a therapeutically effective amount of an inhibitor of CD30 ligand to the subject, provided the presence of the genotype is identified in step (a).
111. The method of embodiments 108-110, wherein the polymorphism at rs1006026 comprises a "G" allele at nucleobase 501 within rs1006026 (SEQ ID NO: 3).
112. The method of embodiment 111, the genotype is homozygous for the "G" allele.
113. The method of embodiment 108-112, wherein the polymorphism at rs911605 comprises an "A" allele at nucleobase 501 within rs911605 (SEQ ID NO: 1).
114. The methods of embodiments 108-113, wherein LD is defined by (i) a D' value of at least about 0.70, or (ii) a D' value of 0 and an $R^2$ value of at least about 0.70.
115. The methods of embodiments 108-113, wherein LD is defined by (i) a D' value of at least about 0.80, or (ii) a D' value of 0 and an $R^2$ value of at least about 0.80.
116. The methods of embodiments 108-113, wherein LD is defined by (i) a D' value of at least about 0.90, or (ii) a D' value of 0 and an $R^2$ value of at least about 0.90.
117. The methods of embodiments 108-113, wherein LD is defined by (i) a D' value of at least about 0.95, or (ii) a D' value of 0 and an $R^2$ value of at least about 0.95.
118. The method of embodiment 108-118, wherein the at least one of the inflammatory disease, the fibrostenotic disease, and the fibrotic disease is Crohn's disease (CD).
119. The method of embodiment 118, wherein the CD is obstructive CD.
120. The method of embodiment 118, wherein the at least one of the inflammatory disease, the fibrostenotic disease, and the fibrotic disease is a liver disease.
121. The method of embodiment 120, wherein the liver disease is primary sclerosing cholangitis.

Kits

The disclosure also provides kits for detecting the presence, absence, and/or quantity of a target nucleic acid described herein. In some instances, kits are provided for detecting and/or quantifying a nucleic acid sequence of genotype disclosed herein, including a polymorphism at rs911605 with an "A" at position 501. In some cases, the kits provide for detection of whether or not a subject is homozygous or heterozygous for the "A" allele at rs911605. In some instances, kits are provided for detecting and/or quantifying a nucleic acid sequence comprising an allele at rs1106026. In some cases, the allele at rs1106026 comprises an "G." In some cases, the kits provide for detection of whether or not a subject is homozygous or heterozygous for the "G" allele at rs1006026.

In some embodiments, the kit includes nucleic acid or polypeptide isolation reagents. In some embodiments, the kit includes one or more detection reagents, for example probes and/or primers for amplification of, or hybridization to, a target nucleic acid sequence related to a disease or condition, such as an inflammatory disease, fibrostenotic disease, and/or fibrotic disease. In some embodiments, the kit includes primers and probes for control genes, such as housekeeping genes. In some embodiments, the primers and probes for control genes are used, for example, in $\Delta C_t$ calculations. In some embodiments, the probes or primers are labeled with an enzymatic, florescent, or radionuclide label.

In some instances, kits comprise primers for identifying a polymorphism at rs911605. In some instances, kits comprise primers for identifying a polymorphism at rs1006026. In some instances, kits comprise a first primer pair for identifying rs911605 and a second primer pair for identifying rs1006026. In some instances, a primer comprises a sequence of at least about 10 contiguous nucleobases of SEQ ID NO: 1. In some cases, a primer comprises a sequence of at least about 10 contiguous nucleobases of the reverse complement of SEQ ID NO: 1. In some instances, a primer comprises a sequence of at least about 10 contiguous nucleobases of SEQ ID NO: 2. In some cases, a primer comprises a sequence of at least about 10 contiguous nucleobases of the reverse complement of SEQ ID NO: 2. In some instances, a primer comprises a sequence of at least about 10 contiguous nucleobases of SEQ ID NO: 3. In some cases, a primer comprises a sequence of at least about 10 contiguous nucleobases of the reverse complement of SEQ ID NO: 3. In some instances, a primer comprises a sequence of at least about 10 contiguous nucleobases of SEQ ID NO: 4. In some cases, a primer comprises a sequence of at least about 10 contiguous nucleobases of the reverse complement of SEQ ID NO: 4. In some instances, a primer comprises a sequence of at least about 10 contiguous nucleobases of SEQ ID NO: 5. In some cases, a primer comprises a sequence of at least about 10 contiguous nucleobases of the reverse complement of SEQ ID NO: 5. In some instances, a primer comprises a sequence of at least about 10 contiguous nucleobases of SEQ ID NO: 6. In some cases, a primer comprises a sequence of at least about 10 contiguous nucleobases of the reverse complement of SEQ ID NO: 6. In some instances, a primer comprises a sequence of at least about 10 contiguous nucleobases of SEQ ID NO: 7. In some cases, a primer comprises a sequence of at least about 10 contiguous nucleobases of the reverse complement of SEQ ID NO: 7. In some instances, a primer comprises a sequence of at least about 10 contiguous nucleobases of SEQ ID NO: 8. In some cases, a primer comprises a sequence of at least about 10 contiguous nucleobases of the reverse complement of SEQ ID NO: 8.

In some instances, a primer pair comprises SEQ ID NOS: 9 and 10. In some instances, a primer comprises at least about 70%, 80%, 85%, 90%, 91%, 92%, 93%, 94%, 95%, 96%, 97%, 98% or 99% sequence identity to SEQ ID NO: 9. In some instances, a primer comprises at least about 70%, 80%, 85%, 90%, 91%, 92%, 93%, 94%, 95%, 96%, 97%, 98% or 99% sequence identity to SEQ ID NO: 10. In some instances, a primer pair comprises SEQ ID NOS: 11 and 12. In some instances, a primer comprises at least about 70%, 80%, 85%, 90%, 91%, 92%, 93%, 94%, 95%, 96%, 97%, 98% or 99% sequence identity to SEQ ID NO: 11. In some instances, a primer comprises at least about 70%, 80%, 85%, 90%, 91%, 92%, 93%, 94%, 95%, 96%, 97%, 98% or 99% sequence identity to SEQ ID NO: 12.

In some instances, kits described herein comprise a probe. In some instances, the probe hybridizes to a polynucleotide sequence comprising an allele at rs911605. In some cases, the allele at rs911605 is an "A" allele. In some instances, the probe hybridizes to a polynucleotide sequence comprising an allele at rs1006026. In some cases, the allele at rs1006026 is a "G" allele. In some instances, the probe comprises SEQ ID NO: 13. In some instances, the probe comprises at least about 70%, 80%, 85%, 90%, 91%, 92%, 93%, 94%, 95%, 96%, 97%, 98% or 99% sequence identity to SEQ ID NO: 13. In some instances, the probe comprises SEQ ID NO: 14. In some instances, the probe comprises at least about 70%, 80%, 85%, 90%, 91%, 92%, 93%, 94%, 95%, 96%, 97%, 98% or 99% sequence identity to SEQ ID NO: 14. In some instances, the probe comprises SEQ ID NO: 15. In some instances, the probe comprises at least about 70%, 80%, 85% 90%, 91%, 92%, 93%, 94%, 95% 96%, 97%, 98% or 99% sequence identity to SEQ ID NO: 15. In some instances, the probe comprises SEQ ID NO: 16. In some instances, the probe comprises at least about 70%, 80%, 85%, 90%, 91%, 92%, 93%, 94%, 95%, 96%, 97%, 98% or 99% sequence identity to SEQ ID NO: 16.

Kits described herein may be used for identifying a particular genotype. In some instances, the kits are used to amplify nucleic acid material comprising or suspected of comprising a target nucleic acid sequence of a rs911605A genotype. In some instances, the kits are used to amplify nucleic acid material comprising or suspected of comprising a target nucleic acid sequence of a rs1006026G genotype. In some instances, the kits are used to amplify nucleic acid material comprising or suspected of comprising a target nucleic acid sequence of a rs911605A genotype and target nucleic acid of a rs1006026G genotype.

In some embodiments, kits include a carrier, package, or container that is compartmentalized to receive one or more containers such as vials, tubes, and the like, each of the container(s) including one of the separate elements to be used in a method described herein. Suitable containers include, for example, bottles, vials, syringes, and test tubes. In other embodiments, the containers are formed from a variety of materials such as glass or plastic.

In some embodiments, a kit includes one or more additional containers, each with one or more of various materials (such as reagents, optionally in concentrated form, and/or devices) desirable from a commercial and user standpoint for use of described herein. Non-limiting examples of such materials include, but not limited to, buffers, primers, enzymes, diluents, filters, carrier, package, container, vial and/or tube labels listing contents and/or instructions for use and package inserts with instructions for use. A set of instructions is optionally included. In a further embodiment, a label is on or associated with the container. In yet a further embodiment, a label is on a container when letters, numbers or other characters forming the label are attached, molded or etched into the container itself; a label is associated with a container when it is present within a receptacle or carrier that also holds the container, e.g., as a package insert. In other embodiments a label is used to indicate that the contents are to be used for a specific therapeutic application. In yet another embodiment, a label also indicates directions for use of the contents, such as in the methods described herein.

Systems

Disclosed herein, in some embodiments, is a system for detecting a particular genotype in a subject. In some embodiments, the genotype comprises a polymorphism in rs911605. In some embodiments, the genotype comprises a polymorphism in rs1006026. In some embodiments, the genotype is a haplotype comprising a polymorphism in rs911605 and a polymorphism in rs1006026. The system is configured to implement the methods described in this disclosure, including, but not limited to, detecting the presence of a particular genotype to determine whether the subject is suitable for treatment with an inhibitor of CD30L.

In some embodiments, disclosed herein is a system for detecting a genotype in a subject, comprising: (a) a computer processing device, optionally connected to a computer network; and (b) a software module executed by the computer processing device to analyze a target nucleic acid sequence of a genotype comprising a polymorphism at rs911605 and/or rs1006026 in a sample from a subject. In some instances, the genotpye comprises rs911605A and/or rs1006026G. In some instances, the system comprises a central processing unit (CPU), memory (e.g., random access memory, flash memory), electronic storage unit, computer program, communication interface to communicate with one or more other systems, and any combination thereof. In some instances, the system is coupled to a computer network, for example, the Internet, intranet, and/or extranet that is in communication with the Internet, a telecommunication, or data network. In some embodiments, the system comprises a storage unit to store data and information regarding any aspect of the methods described in this disclosure. Various aspects of the system are a product or article or manufacture.

One feature of a computer program includes a sequence of instructions, executable in the digital processing device's CPU, written to perform a specified task. In some embodiments, computer readable instructions are implemented as program modules, such as functions, features, Application Programming Interfaces (APIs), data structures, and the like, that perform particular tasks or implement particular abstract data types. In some embodiments, the computer program is configured to (a) receive data corresponding to a presence or an absence of a genotype of a subject; (b) detect a presence or an absence of rs911605 and/or rs1006026 (e.g., rs911605A and/or rs1006026G) and generate a score indicative of a risk that the subject has, or will develop a disease or disorder and/or respond to a therapeutic agent described herein. In some embodiments, the score is either positive or negative for the disease or disorder and/or response to the therapeutic agent. In some embodiments, the computer program is trained with plurality of training samples, and wherein the sample from the subject is independent from the plurality of training samples. In some embodiments, the training samples are derived from a reference population of individuals diagnosed with the disease or disorder, and a reference population of individual who are normal (e.g., not diagnosed with, and do not have, the disease or disorder). In some embodiments, a polygenic risk score (PRS) is calculated. In some embodiments, the PRS comprises a normalized weighted sum of a number of risk alleles within the genotype present in the subject with weights proportional to a beta value or odds ratio of association between the genotype with the disease or condition. To the extent an absence of a genotype is detected, the systems disclosed herein further comprises utilize data corresponding to a presence or an absence of a surrogate genotype to calculate the PRS. In some embodiments, a surrogate genotype is selected if it is linkage disequilibrium (LD) with the absence genotype, as determined by an $r^2$ value of at least about, 0.8, about 0.85, about 0.90, about 0.95, or about 1.0.

The functionality of the computer readable instructions are combined or distributed as desired in various environments. In some instances, a computer program comprises one sequence of instructions or a plurality of sequences of instructions. A computer program may be provided from one location. A computer program may be provided from a plurality of locations. In some embodiment, a computer program includes one or more software modules. In some embodiments, a computer program includes, in part or in whole, one or more web applications, one or more mobile applications, one or more standalone applications, one or more web browser plug-ins, extensions, add-ins, or add-ons, or combinations thereof.

Web Application

In some embodiments, a computer program includes a web application. In light of the disclosure provided herein, those of skill in the art will recognize that a web application may utilize one or more software frameworks and one or more database systems. A web application, for example, is created upon a software framework such as Microsoft® NET or Ruby on Rails (RoR). A web application, in some instances, utilizes one or more database systems including, by way of non-limiting examples, relational, non-relational, feature oriented, associative, and XML database systems. Suitable relational database systems include, by way of non-limiting examples, Microsoft® SQL Server, mySQL™, and Oracle®. Those of skill in the art will also recognize that a web application may be written in one or more versions of one or more languages. In some embodiments, a web application is written in one or more markup languages, presentation definition languages, client-side scripting languages, server-side coding languages, database query languages, or combinations thereof. In some embodiments, a web application is written to some extent in a markup language such as Hypertext Markup Language (HTML), Extensible Hypertext Markup Language (XHTML), or eXtensible Markup Language (XML). In some embodiments, a web application is written to some extent in a presentation definition language such as Cascading Style Sheets (CSS). In some embodiments, a web application is written to some extent in a client-side scripting language such as Asynchronous Javascript and XML (AJAX), Flash® Actionscript, Javascript, or Silverlight®. In some embodiments, a web application is written to some extent in a server-side coding language such as Active Server Pages (ASP), ColdFusion®, Perl, Java™, JavaServer Pages (JSP), Hypertext Preprocessor (PHP), Python™, Ruby, Tcl, Smalltalk, WebDNA®, or Groovy. In some embodiments, a web application is written to some extent in a database query language such as Structured Query Language (SQL). A web application may integrate enterprise server products such as IBM® Lotus Domino®. A web application may include a media player element. A media player element may utilize one or more of many suitable multimedia technologies including, by way of non-limiting examples, Adobe® Flash®, HTML 5, Apple QuickTime®, Microsoft® Silverlight®, Java™, and Unity®.

Mobile Application

In some instances, a computer program includes a mobile application provided to a mobile digital processing device. The mobile application may be provided to a mobile digital processing device at the time it is manufactured. The mobile application may be provided to a mobile digital processing device via the computer network described herein.

A mobile application is created by techniques known to those of skill in the art using hardware, languages, and development environments known to the art. Those of skill in the art will recognize that mobile applications may be written in several languages. Suitable programming languages include, by way of non-limiting examples, C, C++, C#, Featureive-C, Java™, Javascript, Pascal, Feature Pascal, Python™, Ruby, VB.NET, WML, and XHTML/HTML with or without CSS, or combinations thereof.

Suitable mobile application development environments are available from several sources. Commercially available development environments include, by way of non-limiting examples, AirplaySDK, alcheMo, Appcelerator®, Celsius, Bedrock, Flash Lite, .NET Compact Framework, Rhomobile, and WorkLight Mobile Platform. Other development environments may be available without cost including, by way of non-limiting examples, Lazarus, MobiFlex, MoSync, and Phonegap. Also, mobile device manufacturers distribute software developer kits including, by way of non-limiting examples, iPhone and iPad (iOS) SDK, Android™ SDK, BlackBerry® SDK, BREW SDK, Palm® OS SDK, Symbian SDK, webOS SDK, and Windows® Mobile SDK.

Those of skill in the art will recognize that several commercial forums are available for distribution of mobile applications including, by way of non-limiting examples, Apple® App Store, Android™ Market, BlackBerry® App World, App Store for Palm devices, App Catalog for webOS, Windows® Marketplace for Mobile, Ovi Store for Nokia® devices, Samsung® Apps, and Nintendo® DSi Shop.

Standalone Application

In some embodiments, a computer program includes a standalone application, which is a program that may be run as an independent computer process, not an add-on to an existing process, e.g., not a plug-in. Those of skill in the art will recognize that standalone applications are sometimes compiled. In some instances, a compiler is a computer program(s) that transforms source code written in a programming language into binary feature code such as assembly language or machine code. Suitable compiled programming languages include, by way of non-limiting examples, C, C++, Featureive-C, COBOL, Delphi, Eiffel, Java™, Lisp, Python™, Visual Basic, and VB NET, or combinations thereof. Compilation may be often performed, at least in part, to create an executable program. In some instances, a computer program includes one or more executable complied applications.

Web Browser Plug-in

A computer program, in some aspects, includes a web browser plug-in. In computing, a plug-in, in some instances, is one or more software components that add specific functionality to a larger software application. Makers of software applications may support plug-ins to enable third-party developers to create abilities which extend an application, to support easily adding new features, and to reduce the size of an application. When supported, plug-ins enable customizing the functionality of a software application. For example, plug-ins are commonly used in web browsers to play video, generate interactivity, scan for viruses, and display particular file types. Those of skill in the art will be familiar with several web browser plug-ins including, Adobe® Flash® Player, Microsoft® Silverlight®, and Apple® QuickTime®. The toolbar may comprise one or more web browser extensions, add-ins, or add-ons. The toolbar may comprise one or more explorer bars, tool bands, or desk bands.

In view of the disclosure provided herein, those of skill in the art will recognize that several plug-in frameworks are available that enable development of plug-ins in various programming languages, including, by way of non-limiting examples, C++, Delphi, Java™, PHP, Python™, and VB .NET, or combinations thereof.

In some embodiments, Web browsers (also called Internet browsers) are software applications, designed for use with network-connected digital processing devices, for retrieving, presenting, and traversing information resources on the World Wide Web. Suitable web browsers include, by way of non-limiting examples, Microsoft® Internet Explorer®, Mozilla® Firefox®, Google® Chrome, Apple® Safari®, Opera Software® Opera®, and KDE Konqueror. The web browser, in some instances, is a mobile web browser. Mobile web browsers (also called mircrobrowsers, mini-browsers, and wireless browsers) may be designed for use on mobile digital processing devices including, by way of non-limiting examples, handheld computers, tablet computers, netbook computers, subnotebook computers, smartphones, music players, personal digital assistants (PDAs), and handheld video game systems. Suitable mobile web browsers include, by way of non-limiting examples, Google® Android® browser, RIM BlackBerry® Browser, Apple® Safari®, Palm® Blazer, Palm® WebOS® Browser, Mozilla® Firefox® for mobile, Microsoft® Internet Explorer® Mobile, Amazon® Kindle® Basic Web, Nokia® Browser, Opera Software® Opera® Mobile, and Sony® PSP™ browser.

Software Modules

The medium, method, and system disclosed herein comprise one or more softwares, servers, and database modules, or use of the same. In view of the disclosure provided herein, software modules may be created by techniques known to those of skill in the art using machines, software, and languages known to the art. The software modules disclosed herein may be implemented in a multitude of ways. In some embodiments, a software module comprises a file, a section of code, a programming feature, a programming structure, or combinations thereof. A software module may comprise a plurality of files, a plurality of sections of code, a plurality of programming features, a plurality of programming structures, or combinations thereof. By way of non-limiting examples, the one or more software modules comprise a web application, a mobile application, and/or a standalone application. Software modules may be in one computer program or application. Software modules may be in more than one computer program or application. Software modules may be hosted on one machine. Software modules may be hosted on more than one machine. Software modules may be hosted on cloud computing platforms. Software modules may be hosted on one or more machines in one location. Software modules may be hosted on one or more machines in more than one location.

Databases

The medium, method, and system disclosed herein comprise one or more databases, or use of the same. In view of the disclosure provided herein, those of skill in the art will recognize that many databases are suitable for storage and retrieval of geologic profile, operator activities, division of interest, and/or contact information of royalty owners. Suitable databases include, by way of non-limiting examples, relational databases, non-relational databases, feature oriented databases, feature databases, entity-relationship model databases, associative databases, and XML databases. In some embodiments, a database is internet-based. In some embodiments, a database is web-based. In some embodiments, a database is cloud computing-based. A database may be based on one or more local computer storage devices.

Data Transmission

The subject matter described herein, including methods for detecting a particular genotype, are configured to be performed in one or more facilities at one or more locations. Facility locations are not limited by country and include any country or territory. In some instances, one or more steps are performed in a different country than another step of the method. In some instances, one or more steps for obtaining a sample are performed in a different country than one or more steps for detecting the presence or absence of a particular genotype from a sample. In some embodiments, one or more method steps involving a computer system are performed in a different country than another step of the methods provided herein. In some embodiments, data processing and analyses are performed in a different country or location than one or more steps of the methods described herein. In some embodiments, one or more articles, products, or data are transferred from one or more of the facilities to one or more different facilities for analysis or further analysis. An article includes, but is not limited to, one or more components obtained from a subject, e.g., processed cellular material. Processed cellular material includes, but is not limited to, cDNA reverse transcribed from RNA, amplified RNA, amplified cDNA, sequenced DNA, isolated and/or purified RNA, isolated and/or purified DNA, and isolated and/or purified polypeptide. Data includes, but is not limited to, information regarding the genotype of a subject, quantity of CD30, and any data produced by the methods disclosed herein. In some embodiments of the methods and systems described herein, the analysis is performed and a subsequent data transmission step will convey or transmit the results of the analysis.

In some embodiments, any step of any method described herein is performed by a software program or module on a computer. In additional or further embodiments, data from any step of any method described herein is transferred to and from facilities located within the same or different countries, including analysis performed in one facility in a particular location and the data shipped to another location or directly to an individual in the same or a different country. In additional or further embodiments, data from any step of any method described herein is transferred to and/or received from a facility located within the same or different countries, including analysis of a data input, such as genetic or processed cellular material, performed in one facility in a particular location and corresponding data transmitted to another location, or directly to an individual, such as data related to the diagnosis, prognosis, responsiveness to therapy, or the like, in the same or different location or country.

Disclosed herein, in some embodiments, are the following:

1. A computer system for evaluating a sample from a subject, the system comprising:
    a) a central computing environment;
    b) an input device operatively connected to said central computing environment, wherein said input device is configured to receive a presence or absence of a genotype that correlates with a disease state in the sample;
    c) a trained algorithm executed by said central computing environment, wherein the trained algorithm is configured to use the presence or absence of the genotype to classify said sample as a disease or normal sample; and
    d) an output device operatively connected to said central computing environment, wherein said output device is configured to provide information on the classification to a user.
2. The computer system of embodiment 1, wherein the disease state comprises at least one of an inflammatory disease, a fibrostenotic disease, and a fibrotic disease.
3. The computer system of embodiment 1 or embodiment 2, wherein the disease state is selected from the group consisting of inflammatory bowel disease (IBD), Crohn's disease (CD), obstructive CD, ulcerative colitis (UC), intestinal fibrosis, intestinal fibrostenosis, and primary sclerosing cholangitis.
4. The computer system of any previous embodiment, wherein the sample comprises whole blood, plasma, serum, or tissue.
5. The computer system of any previous embodiment, wherein the genotype comprises at least one polymorphism selected from any one of Tables 1-14, a polymorphism in linkage disequilibrium (LD) therewith, and any combination thereof.
6. The computer system of any previous embodiment, wherein the genotype comprises at least one of a polymorphism at rs1006026, rs911605, and a polymorphism in linkage disequilibrium (LD) therewith, or any combination thereof.
7. The computer system of embodiment 6, wherein the polymorphism at rs1006026 comprises a "G" allele at nucleobase 501 within rs1006026 (SEQ ID NO: 3).
8. The computer system of embodiment 7, wherein the genotype is homozygous for the "G" allele.
9. The computer system of claim 6, wherein the polymorphism at rs911605 comprises an "A" allele at nucleobase 501 within rs911605 (SEQ ID NO: 1).
10. The computer system of embodiment 5-9, where LD is defined by an $r^2$ value of at least 0.80, 0.85, 0.90, 0.95, or 1.0.
11. The computer system of any previous embodiment, wherein the genotype is associated with a risk that a subject has, or will develop, the disease state by a P value of at most about $1.0 \times 10^{-6}$, about $1.0 \times 10^{-7}$, about $1.0 \times 10^{-8}$, about $1.0 \times 10^{-9}$, about $1.0 \times 10^{-10}$, about $1.0 \times 10^{-20}$, about $1.0 \times 10^{-30}$, about $1.0 \times 10^{-40}$, about $1.0 \times 10^{-50}$, about $1.0 \times 10^{-60}$, about $1.0 \times 10^{-70}$, about $1.0 \times 10^{-80}$, about $1.0 \times 10^{-90}$, or about $1.0 \times 10^{-100}$.
12. The computer system of any previous embodiment, wherein said output device provides a report summarizing said information on said classification.
13. The computer system of any previous embodiment, wherein said report comprises a recommendation for treatment of said disease state.
14. The computer system of embodiment 13, wherein the treatment comprises administration of an inhibitor of CD30 ligand activity or expression.
15. The computer system of embodiment 14, wherein the inhibitor of CD30 ligand activity or expression comprises an antibody or antigen-binding fragment, peptide, or small molecule.
16. The computer system of any preceding embodiment, wherein said genotype is determined with an assay comprising polymerase chain reaction (PCR), quantitative reverse-transcription PCR (qPCR), automated sequencing, genotype array, or a combination thereof.
17. Use of a composition comprising one or more binding agents for generating a report that classifies a sample from as subject as disease or non-disease of a disease state, wherein the one or more binding agents specifically bind to at least one of rs1006026 (SEQ ID NO: 4), rs911605 (SEQ ID NO: 2), their compliment, a polymorphism in linkage disequilibrium therewith, and any combination thereof.
18. The use of embodiment 17, wherein generating the report further comprises:
    a) providing the sample from the subject;
    b) assaying the sample from the subject for detecting the presence of the one or more polymorphisms in one or more genes;
    c) generating the report based on the result of step (b); and
    d) determining whether said subject has or is likely to have the disease based on the results of step (b).
19. The use of embodiment 17 or 18, wherein the disease state comprises at least one of an inflammatory disease, a fibrostenotic disease, and a fibrotic disease.
20. The use of embodiment 17-19, wherein the disease state is selected from the group consisting of inflammatory bowel disease (IBD), Crohn's disease (CD), obstructive CD, ulcerative colitis (UC), intestinal fibrosis, intestinal fibrostenosis, and primary sclerosing cholangitis.
21. The use of any of embodiments 17-20, wherein the sample comprises whole blood, plasma, serum, or tissue.
22. The use of embodiment 18, wherein assaying the sample from the subject for detecting the presence of the one or more polymorphisms of step (b) comprises:
    a) contacting the sample with the one or more binding agents that specifically bind to the one or more polymorphisms; and
    b) determining whether the sample specifically binds to said one or more binding agents, wherein binding of the sample to the one or more binding agents indicates the presence of the polymorphism in the subject.
23. The use of embodiment 18, wherein assaying the sample from the subject for detecting the presence of the one or more polymorphisms of step (b) comprises sequencing of the sample.
24. The use of embodiment 18, wherein assaying the sample from the subject for detecting the presence of the one or more polymorphisms of step (b) comprises quantifying the amount of DNA comprising the at least one of rs1006026 (SEQ ID NO: 4) rs911605 (SEQ ID NO: 2).
25. The use of embodiment 24, wherein the quantifying comprises PCR.
26. The use of embodiment 25, wherein the PCR comprises real-time PCR.
27. The use of embodiment 24, wherein the quantifying comprises hybridization.
28. A composition comprising one or more binding agents that specifically bind to at least one of rs1006026 (SEQ ID NO: 4) rs911605 (SEQ ID NO: 2), or their complement, wherein the one or more binding agents are selected to classify a sample as disease or non-disease of a disease state.
29. The composition of embodiment 28, wherein the one or more binding agents comprise oligonucleotides.
30. The composition of embodiment 29, wherein the oligonucleotides comprise RNA or DNA.
31. The composition of embodiment 29, wherein the one or more binding agents comprise aptamers, antibodies, peptide nucleic acids, or pyranosyl RNA.
32. A kit for detecting at least one of an inflammatory disease, a fibrostenotic disease, and a fibrotic disease in a subject, the kit comprising:
  a) at least one binding agent that specifically binds to at least one of rs1006026 (SEQ ID NO: 4) rs911605 (SEQ ID NO: 2), or their complement, wherein the at least one binding agent is selected to detect a disease or non-disease state; and
  b) reagents for detecting binding of said at least one binding agent to a DNA sample from a subject.
33. The kit of embodiment 32, wherein the at least one binding agent comprises at least one oligonucleotide.
34. The kit of embodiment 32, wherein the at least one binding agent comprises at least one aptamer, antibody, peptide nucleic acid, or pyranosyl RNA.
35. The kit of embodiment 32-34, wherein the at least one binding agent is labelled with a detectable label.
36. The kit of embodiment 32-35 wherein the at least one binding agent is immobilized to a surface.
37. A system for generating a report that classifies a sample a disease or non-disease of a disease state, comprising:
  a) a computer system that;
    i. generates a molecular profile of a DNA sample based upon the presence of at least one polymorphism, or their complement; and
    ii. generates a report that classifies the sample based on said molecular profile; and
  b) a computer screen that displays said report.
38. The system of embodiment 37, wherein the presence of the at least one polymorphism is based on the result of an assay of said DNA sample, which result is entered into a database.
39. The system of embodiment 37-38, further comprising an input for said result.
40. The system of embodiment 37-39, wherein the at least one polymorphism is selected from any one of Tables 1-14.
41. The system of embodiment 37-41, wherein the at least one polymorphism comprises at least one of a polymorphism at rs1006026 (SEQ ID NO: 4), rs911605 (SEQ ID NO: 2), and a polymorphism in linkage disequilibrium therewith.
42. The system of embodiment 41, wherein the polymorphism at rs1006026 is homozygous.

Definitions

In the following description, certain specific details are set forth in order to provide a thorough understanding of various embodiments. However, one skilled in the art will understand that the embodiments provided may be practiced without these details. Unless the context requires otherwise, throughout the specification and claims which follow, the word "comprise" and variations thereof, such as, "comprises" and "comprising" are to be construed in an open, inclusive sense, that is, as "including, but not limited to." As used in this specification and the appended claims, the singular forms "a," "an," and "the" include plural referents unless the content clearly dictates otherwise. It should also be noted that the term "or" is generally employed in its sense including "and/or" unless the content clearly dictates otherwise. Further, headings provided herein are for convenience only and do not interpret the scope or meaning of the claimed embodiments.

As used herein, the terms "homologous," "homology," or "percent homology" when used herein to describe to an amino acid sequence or a nucleic acid sequence, relative to a reference sequence, can be determined using the formula described by Karlin and Altschul (Proc. Natl. Acad. Sci. USA 87: 2264-2268, 1990, modified as in Proc. Natl. Acad. Sci. USA 90:5873-5877, 1993). Such a formula is incorporated into the basic local alignment search tool (BLAST) programs of Altschul et al. (J Mol Biol. 1990 Oct. 5; 215(3):403-10; Nucleic Acids Res. 1997 Sep. 1; 25(17): 3389-402). Percent homology of sequences can be determined using the most recent version of BLAST, as of the filing date of this application. Percent identity of sequences can be determined using the most recent version of BLAST, as of the filing date of this application.

The terms "increased," or "increase" are used herein to generally mean an increase by a statically significant amount. In some embodiments, the terms "increased," or "increase," mean an increase of at least 10% as compared to a reference level, for example an increase of at least about 10%, at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, standard, or control. Other examples of "increase" include an increase of at least 2-fold, at least 5-fold, at least 10-fold, at least 20-fold, at least 50-fold, at least 100-fold, at least 1000-fold or more as compared to a reference level.

The terms, "decreased" or "decrease" are used herein generally to mean a decrease by a statistically significant amount. In some embodiments, "decreased" or "decrease" means a reduction by at least 10% as compared to a reference level, for example a decrease by at least about 20%, or at least about 30%, or at least about 40%, or at least about 50%, or at least about 60%, or at least about 70%, or at least about 80%, or at least about 90% or up to and including a 100% decrease (e.g., absent level or non-detectable level as compared to a reference level), or any decrease between 10-100% as compared to a reference level. In the context of a marker or symptom, by these terms is meant a statistically significant decrease in such level. The decrease can be, for example, at least 10%, at least 20%, at least 30%, at least 40% or more, and is preferably down to a level accepted as within the range of normal for an individual without a given disease.

The terms "subject" encompass mammals. Non-limiting examples of mammal include, any member of the mammalian class: humans, non-human primates such as chimpanzees, and other apes and monkey species; farm animals such as cattle, horses, sheep, goats, swine; domestic animals such as rabbits, dogs, and cats; laboratory animals including rodents, such as rats, mice and guinea pigs, and the like. In one aspect, the mammal is a human. The term "animal" as used herein comprises human beings and non-human animals. In one embodiment, a "non-human animal" is a mammal, for example a rodent such as rat or a mouse. In some instances, a human subject is a "patient," which as used herein, refers to a subject who may be diagnosed with a disease or condition disclosed herein.

The term "gene," as used herein, refers to a segment of nucleic acid that encodes an individual protein or RNA (also referred to as a "coding sequence" or "coding region"), optionally together with associated regulatory region such as promoter, operator, terminator and the like, which may be located upstream or downstream of the coding sequence. A "genetic locus" referred to herein, is a particular location within a gene.

The term, "genotype" as disclosed herein, refers to the chemical composition of polynucleotide sequences within the genome of an individual. In some embodiments, the genotype comprises a single nucleotide polymorphism (SNP) or and indel (insertion or deletion, of a nucleobase within a polynucleotide sequence). In some embodiments, a genotype for a particular SNP, or indel is heterozygous. In some embodiments, a genotype for a particular SNP, or indel is homozygous.

A "polymorphism" as used herein refers to an aberration in (e.g., a mutation), or of (e.g., insertion/deletion), a nucleic acid sequence, as compared to the nucleic acid sequence in a reference population. In some embodiments, the polymorphism is common in the reference population. In some embodiments, the polymorphism is rare in the reference population.

The term, "single nucleotide polymorphism" or SNP as disclosed herein, refers to a variation in a single nucleotide within a polynucleotide sequence. The term should not be interpreted as placing a restriction on a frequency of the SNP in a given population. The variation of an SNP may have multiple different forms. A single form of an SNP is referred to as an "allele." An SNP can be mono-, bi-, tri, or tetra-allelic. A SNP may include a "risk allele," a "protective allele," or neither. By way of example, a reference polynucleotide sequence reading 5' to 3' is TTACG. A SNP at allele position 3 (of 5'-TTACG-3') comprise a substitution of the reference allele, "A" to a non-reference allele, "C." If the "C" allele of the SNP is associated with an increased probability of developing a phenotypic trait, the allele is considered a "risk" allele. However, the same SNP may also comprise a substitution of the "A" allele to a "T" allele at position 3. If the T allele of the SNP is associated with a decreased probability of developing a phenotypic trait, the allele is considered a "protective" allele. The SNP may be observed in at least 1% of a given population. In some embodiments, the SNP is represented by an "rs" number, which refers to the accession of reference cluster of one more submitted SNPs in the dbSNP bioinformatics database as of the filing date of this patent application, and which is included within a sequence that comprises the total number of nucleobases from 5' to 3'. In some embodiments, a SNP may be further defined by the position of the SNP (nucleobase) within the dbSNP sequence, the position of which is always with reference to 5' length of the sequence plus 1. In some embodiments, a SNP is defined as the genomic position in a reference genome and the allele change (e.g. chromosome 7 at position 234,123,567 from G allele to A allele in the reference human genome build 37). In some embodiments, the SNV is defined as the genomic position identified with [brackets] or an "N" in a sequence disclosed herein.

The term, "indel," as disclosed herein, refers to an insertion, or a deletion, of a nucleobase within a polynucleotide sequence. An indel can be mono-, bi-, tri, or tetra-allelic. An indel may be "risk," a "protective," or neither, for a phenotypic trait. In some embodiments, the indel is represented by an "rs" number, which refers to the accession of reference cluster of one more submitted indels in the dbSNP bioinformatics database as of the filing date of this patent application, and which is included in a sequence that comprises the total number of nucleobases from 5' to 3'. In some embodiments, an indel may be further defined by the position of the insertion/deletion within the dbSNP sequence, the position of which is always with reference to the 5' length of the sequence plus 1. In some embodiments, an indel is defined as the genomic position in a reference genome and the allele change. In some embodiments, the indel is defined as the genomic position identified with [brackets] or an "N" in a sequence disclosed herein.

"Haplotype" as used herein, encompasses a group of one or more genotypes, which tend to be inherited together in a reference population. In some embodiments, a haplotype comprises particular polymorphism or another polymophism in linkage disequilibrium (LD) therewith.

"Linkage disequilibrium," or "LD," as used herein refers to the non-random association of alleles or indels in different gene loci in a given population. LD may be defined by a D' value corresponding to the difference between an observed and expected allele or indel frequencies in the population (D=Pab-PaPb), which is scaled by the theoretical maximum value of D. LD may be defined by an $r^2$ value corresponding to the difference between an observed and expected unit of risk frequencies in the population (D=Pab-PaPb), which is scaled by the individual frequencies of the different loci. In some embodiments, D' comprises at least 0.20. In some embodiments, $r^2$ comprises at least 0.70.

The term "medically refractory," or "refractory," as used herein, refers to the failure of a standard treatment to induce remission of a disease. In some embodiments, the disease comprises an inflammatory disease disclosed herein. A non-limiting example of refractory inflammatory disease includes refractory Crohn's disease, and refractory ulcerative colitis (e.g., mrUC). Non-limiting examples of standard treatment include glucocorticosteriods, anti-TNF therapy, anti-a4-b7 therapy (vedolizumab), anti-IL12p40 therapy (ustekinumab), Thalidomide, and Cytoxin.

The terms "treat," "treating," and "treatment" as used herein refers to alleviating or abrogating a disorder, disease, or condition; or one or more of the symptoms associated with the disorder, disease, or condition; or alleviating or eradicating a cause of the disorder, disease, or condition itself. Desirable effects of treatment can include, but are not limited to, preventing occurrence or recurrence of disease, alleviation of symptoms, diminishing any direct or indirect pathological consequences of the disease, preventing metastasis, decreasing the rate of disease progression, amelioration or palliation of the disease state and remission or improved prognosis.

The term "therapeutically effective amount" refers to the amount of a compound or therapy that, when administered, is sufficient to prevent development of, or alleviate to some extent, one or more of the symptoms of a disorder, disease, or condition of the disease; or the amount of a compound that is sufficient to elicit biological or medical response of a cell, tissue, system, animal, or human that is being sought by a researcher, veterinarian, medical doctor, or clinician.

The term "pharmaceutically acceptable carrier," "pharmaceutically acceptable excipient," "physiologically acceptable carrier," or "physiologically acceptable excipient" refers to a pharmaceutically-acceptable material, composition, or vehicle, such as a liquid or solid filler, diluent, excipient, solvent, or encapsulating material. A component can be "pharmaceutically acceptable" in the sense of being compatible with the other ingredients of a pharmaceutical formulation. It can also be suitable for use in contact with the tissue or organ of humans and animals without excessive toxicity, irritation, allergic response, immunogenicity, or other problems or complications, commensurate with a reasonable benefit/risk ratio. See, Remington: The Science and Practice of Pharmacy, 21st Edition; Lippincott Williams & Wilkins: Philadelphia, Pa., 2005; Handbook of Pharmaceutical Excipients, 5th Edition; Rowe et al., Eds., The Pharmaceutical Press and the American Pharmaceutical Association: 2005; and Handbook of Pharmaceutical Additives, 3rd Edition; Ash and Ash Eds., Gower Publishing Company: 2007; Pharmaceutical Preformulation and Formulation, Gibson Ed., CRC Press LLC: Boca Raton, Fla., 2004).

The term "pharmaceutical composition" refers to a mixture of a compound disclosed herein with other chemical components, such as diluents or carriers. The pharmaceutical composition can facilitate administration of the compound to an organism. Multiple techniques of administering a compound exist in the art including, but not limited to, oral, injection, aerosol, parenteral, and topical administration.

The term "inflammatory bowel disease" or "IBD" as used herein refers to gastrointestinal disorders of the gastrointestinal tract. Non-limiting examples of IBD include, Crohn's disease (CD), ulcerative colitis (UC), indeterminate colitis (IC), microscopic colitis, diversion colitis, Behcet's disease, and other inconclusive forms of IBD. In some instances, IBD comprises fibrosis, fibrostenosis, stricturing and/or penetrating disease, obstructive disease, or a disease that is refractory (e.g., mrUC, refractory CD), perianal CD, or other complicated forms of IBD.

Non-limiting examples of "sample" include any material from which nucleic acids and/or proteins can be obtained. As non-limiting examples, this includes whole blood, peripheral blood, plasma, serum, saliva, mucus, urine, semen, lymph, fecal extract, cheek swab, cells or other bodily fluid or tissue, including but not limited to tissue obtained through surgical biopsy or surgical resection. In various embodiments, the sample comprises tissue from the large and/or small intestine. In various embodiments, the large intestine sample comprises the cecum, colon (the ascending colon, the transverse colon, the descending colon, and the sigmoid colon), rectum and/or the anal canal. In some embodiments, the small intestine sample comprises the duodenum, jejunum, and/or the ileum. Alternatively, a sample can be obtained through primary patient derived cell lines, or archived patient samples in the form of preserved samples, or fresh frozen samples.

The term "biomarker" comprises a measurable substance in a subject whose presence, level, or activity, is indicative of a phenomenon (e.g., phenotypic expression or activity; disease, condition, subclinical phenotype of a disease or condition, infection; or environmental stimuli). In some embodiments, a biomarker comprises a gene, gene expression product (e.g., RNA or protein), or a cell-type (e.g., immune cell).

The term "serological marker," as used herein refers to a type of biomarker representing an antigenic response in a subject that may be detected in the serum of the subject. In some embodiments, a serological comprises an antibody against various fungal antigens. Non-limiting examples of a serological marker comprise anti-*Saccharomyces cerevisiae* antibody (ASCA), an anti-neutrophil cytoplasmic antibody (ANCA), *E. coli* outer membrane porin protein C (OmpC), anti-*Malassezia restricta* antibody, anti-*Malassezia pachydermatis* antibody, anti-*Malassezia furfur* antibody, anti-*Malassezia globasa* antibody, anti-*Cladosporium albicans* antibody, anti-laminaribiose antibody (ALCA), anti-chitobioside antibody (ACCA), anti-laminarin antibody, anti-chitin antibody, pANCA antibody, anit-I2 antibody, and anti-Cbirl flagellin antibody.

The term "microbiome" and its variation used herein describe the populations and interactions of the bacteria, fungi, protists, and virus that align the gastrointestinal tract of a subject. A subject afflicted with IBD may possess presence, absence, excess, diminished, or a combination thereof of a microbiome s compared to a healthy subject.

The terms "non-response," or "loss-of-response," as used herein, refer to phenomena in which a subject or a patient does not respond to the induction of a standard treatment (e.g., anti-TNF therapy), or experiences a oss of response to the standard treatment after a successful induction of the therapy. The induction of the standard treatment may include 1, 2, 3, 4, or 5, doses of the therapy. A "successful induction" of the therapy may be an initial therapeutic response or benefit provided by the therapy. The loss of response may be characterized by a reappearance of symptoms consistent with a flare after a successful induction of the therapy.

EXAMPLES

While preferred embodiments have been shown and described herein, it will be obvious to those skilled in the art that such embodiments are provided by way of example only. Numerous variations, changes, and substitutions will now occur to those skilled in the art without departing from the embodiments provided. It should be understood that various alternatives to the embodiments described herein may be employed.

Example 1: Identification of Genotypes

Patients with IBD were recruited at the Cedars-Sinai Inflammatory Bowel Disease Centers. The diagnosis of each patient was based on standard endoscopic, histologic, and radiographic features. Blood samples were collected from patients at the time of enrollment. Blood samples were also collected from individuals without IBD. Genotyping was performed at Cedars-Sinai Medical Center using Illumina whole-genome arrays per manufacturer's protocol (Illumina, San Diego, Calif.) on all samples collected. Markers/SNPs were excluded from analysis if: there were deviations in Hardy-Weinberg Equilibrium in controls with p≤0.0001; missingness in SNPs>2% and minor allele frequency <1%. Related individuals (Pi-hat scores >0.25) were identified using identity-by-descent and excluded from analysis (PLINK). Admixture was used to generate ethnicity proportion estimations for all individuals. Only subjects identified by admixture as Caucasian (proportion <0.75) were included in the analysis.

Multiple large-scale case-control association studies involving Inflammatory Bowel Disease (IBD) Crohn's disease (CD), and ulcerative colitis (UC) in Caucasian populations using gene-based single nucleotide polymorphism (SNP) markers were performed. The studies included patients recruited at the Cedars-Sinai Inflammatory Bowel Disease Centers with Inflammatory Bowel Disease (IBD) (n=9360), Crohn's disease (CD)(n=7965), and ulcerative colitis (UC) (n=6864). The studies also included GWAS data derived from the International Inflammatory Bowel Diseases Genetic Consortium (IIBDGC). A P value cutoff of 0.05 was used. Table 2 provides SNPs identified as being associated with IBD. Table 1 provides SNPs identified as being associated with CD. Table 3 provides SNPs identified as being associated with UC. The allele "A" within rs911605 (rs911605A) SNP was show to be significantly associated with IBD ($P=5.21\times10^{-4}$), Crohn's disease (CD) ($rP=1.70\times10^{-3}$) and ulcerative colitis (UC) ($P=4.54\times10^{-2}$). The rs1006026G was show to be moderately associated with IBD ($P=6.67\times10^{-1}$), CD ($P=4.43\times10^{-1}$), and UC ($P=8.92\times10^{-1}$).

Example 2: eQTL in Small Bowel Resection Identifies Polymorphisms as Functionally Related to CD30L Protein Expression 85 Caucasian patients with Crohn's disease (CD) who underwent small bowel resection were recruited at the Cedars-Sinai Inflammatory Bowel Disease Centers. The diagnosis of each patient was based on standard endoscopic, histologic, and radiographic features. Patients were selected based on being diagnosed with CD and having undergone small bowel resection for disease. Tissue biopsy samples were collected from uninvolved tissue sections taken from small bowel resection after surgery. Expression Quantitative Trait Loci Mapping (eQTL) was performed on these samples. Table 13 provides polymorphisms associated with a decrease in CD30. Table 14 provides polymorphisms associated with an increase in CD30. Negative beta values represent a decrease in gene expression, whereas positive beta values represent an increase in gene expression, in the tissue samples. Positive beta values were observed for the polymorphisms rs911605 (SEQ ID NO: 2) and rs1006026 (SEQ ID NO: 4). FIG. 1 shows that the risk allele, "A" within rs911605 ($P=4.41\times10^{-4}$)—rs911605A (X=1) or rs911605AA (X=2) is associated with increased expression of TNFSF8 mRNA in the small bowel using cis-eQTL, as compared to individuals who do not carry the risk allele, or "non-risk, GG" (X=0). Without being bound by any particular theory, this is highly suggestive that expression of these polymorphisms is associated with increased CD30L protein expression in subjects with CD. Increased CD30L is defined as +2 standard deviation over the mean CD30L level of a control derived from a non-diseased individual or population of non-diseased individuals.

Figure 2:
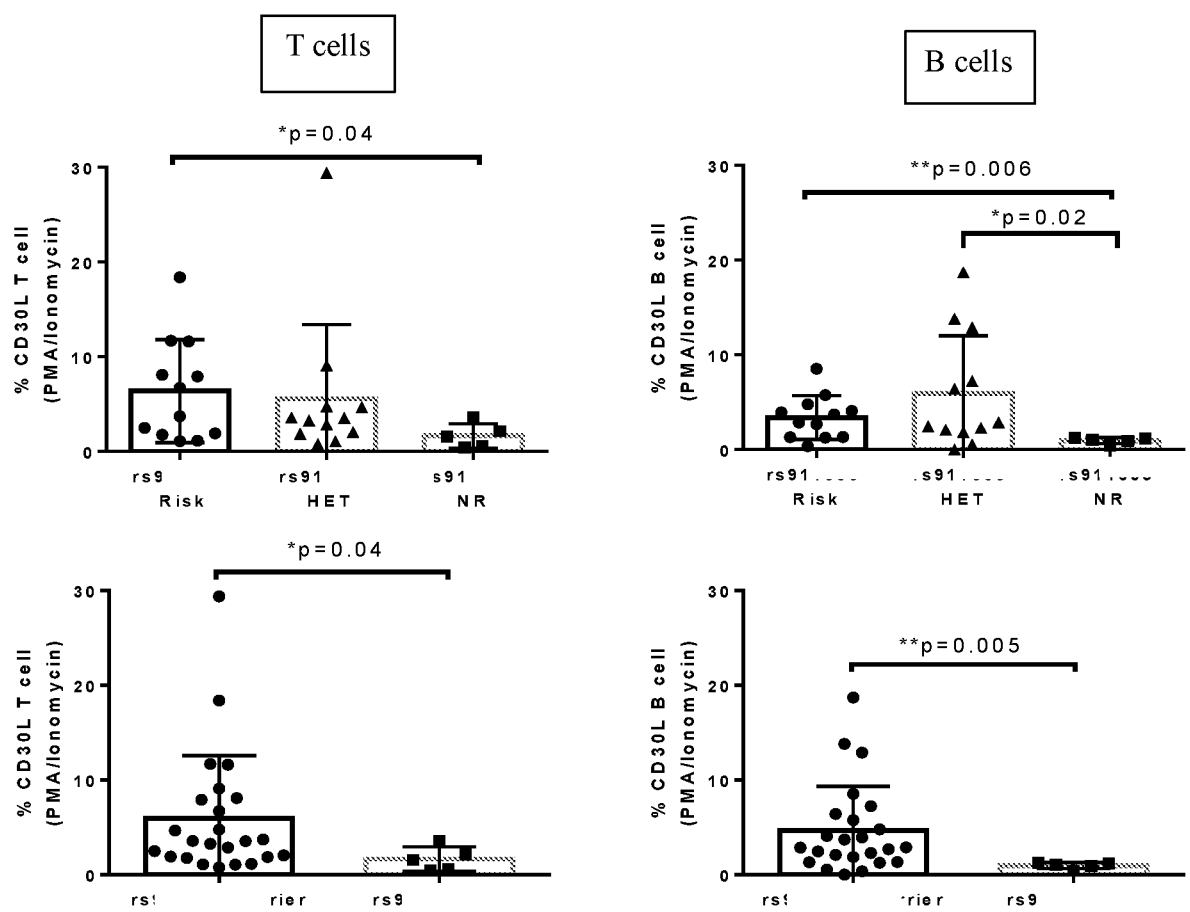
FIG. 2. shows CD30L protein expression is upregulated on T cells and B cells in samples obtained from subjects carrying the rs911605A or rs911605AA risk genotypes, as compared to non-risk ("NR") individual who does not express the risk genotypes.
Figure 3:
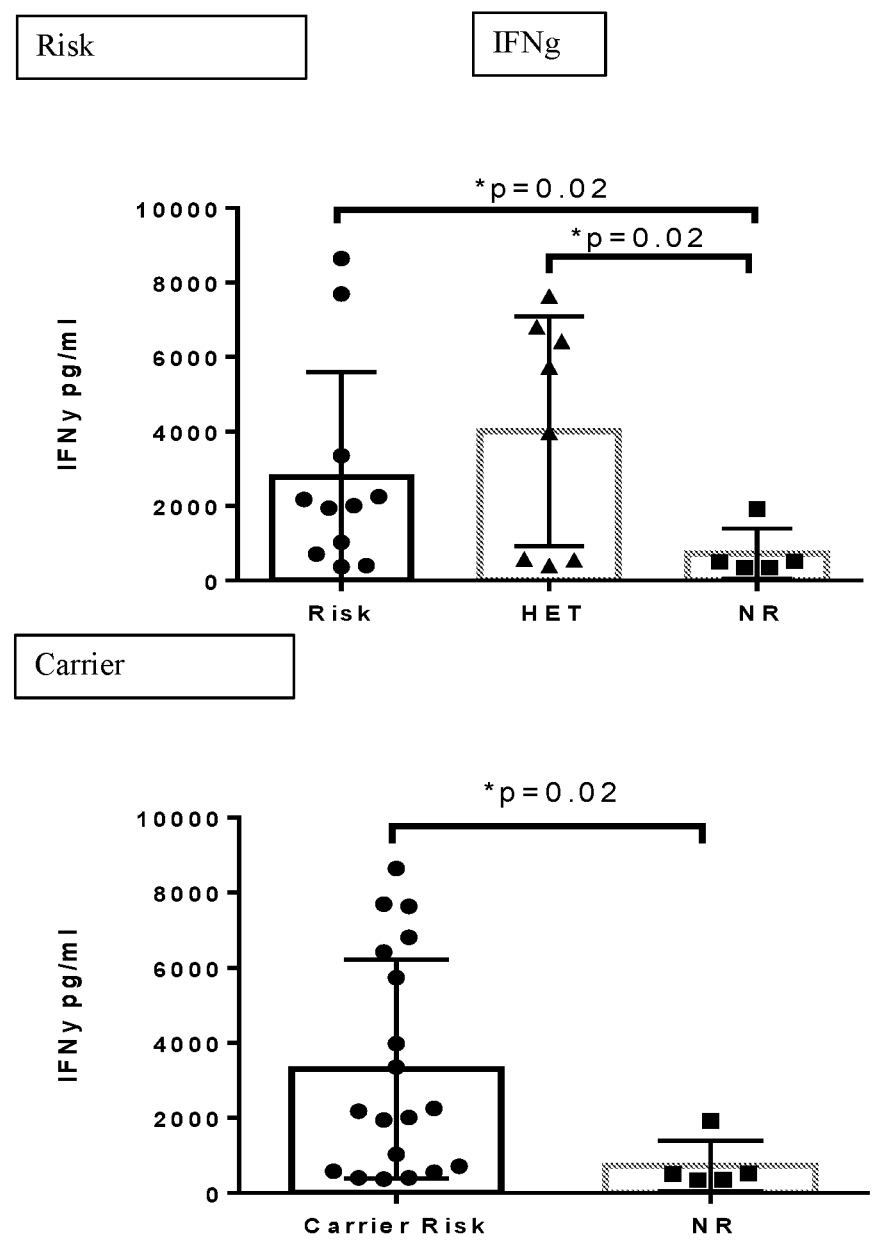
FIG. 3. shows an increase in expression of interferon gamma, (IFN-gamma or IFNg) in samples obtained from subjects, as compared to non-risk ("NR") individual who does not express the risk genotypes.
Figure 4:
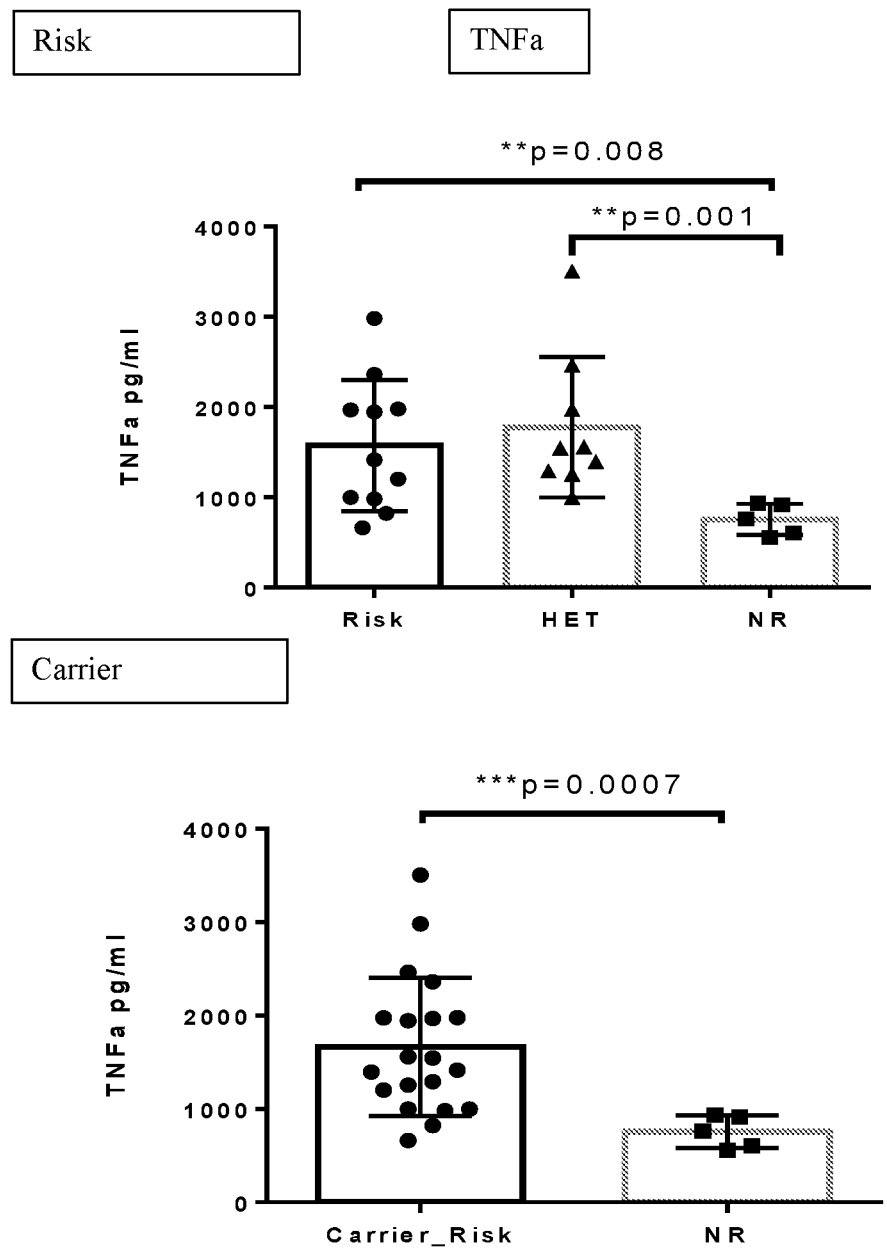
FIG. 4 shows an increase in expression of tumor necrosis factor alpha (TNFa) in samples obtained from subjects, as compared to non-risk ("NR") individual who does not express the risk genotypes
Figure 5:
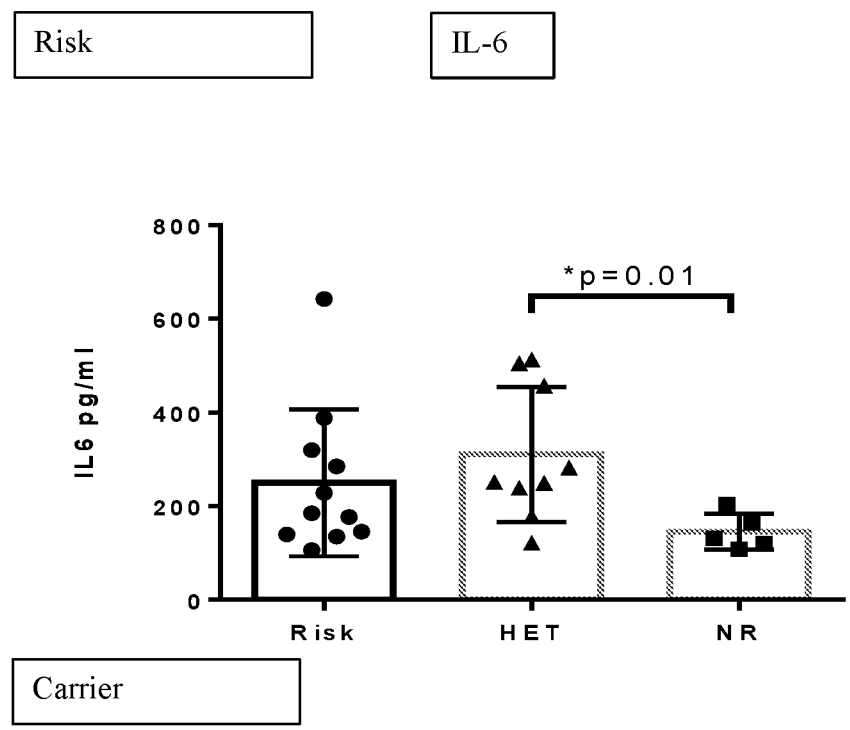
FIG. 5 shows an increase in expression of interleukin 6 (IL-6) in samples obtained from subjects, as compared to non-risk ("NR") individual who does not express the risk genotypes.
Figure 5:
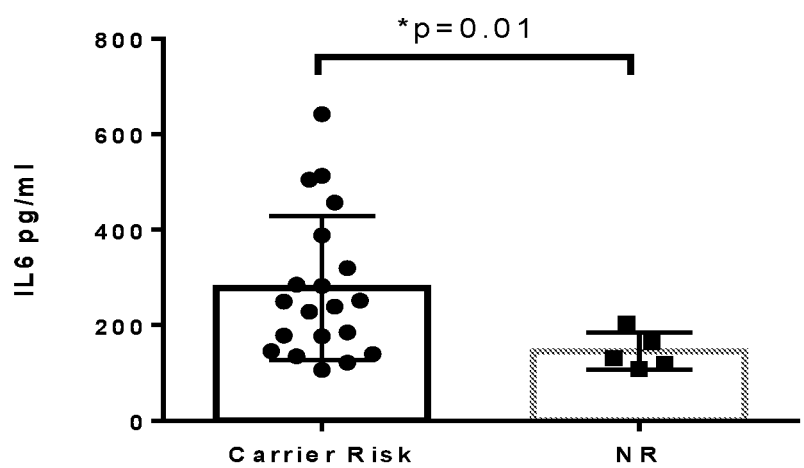

Example 3. Polymorphism Expression Effects Expression and Function of CD30L and Pro-Inflammatory Cytokines in Peripheral Blood Patients with Crohn's Disease (CD) were recruited at the Cedars-Sinai Inflammatory Bowel Disease Centers. The diagnosis of each patient was based on standard endoscopic, histologic, and radiographic features. Patients were selected based on being diagnosed with CD. Samples of peripheral blood were collected from patients at the time of enrollment. Peripheral blood mononuclear cells (PBMC) were isolated on standard Ficoll-Hypaque density gradients. PBMC were stimulated in vitro under conditions that would up-regulate either CD30L (phorbol 12-myristate 13-acetate (PMA) and ionomycin) or CD30 (anti-CD3 antibody and anti-CD28 antibody) for 72 hours. Supernatants were collected for analysis of cytokines at 6, 24 and 72, hours and cells were collected after 72 hours and analyzed for expression of CD30 and CD30L by flow cytometry. Both T and B cells expressed increased levels of CD30L in subjects that carried (either homozygous or heterozygous) the risk polymorphism for rs911605 (rs911605A or rs911605AA) (FIG. 2). Analysis of TNF-alpha, interleukin 6 (IL-6), and interferon-gamma (IFN-gamma) in the supernatants from cultures showed that cells from patients that carried the polymorphism for rs911605 produced elevated levels of pro-inflammatory cytokines following stimulation (FIGS. 3-5). Without being bound by any particular theory, these findings are highly suggestive that the genotype comprising rs911605A or rs911605AA is correlated with an increase in expression of CD30L and pro-inflammatory cytokines involved in the pathogenesis of IBD.

Figure 6A:
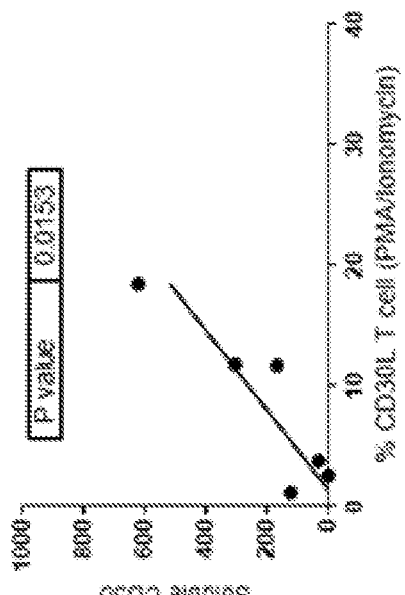
FIG. 6A-6C shows CD30L expression is correlated with levels of soluble CD30 (sCD30) in patient population carrying various genotypes, including rs911605AA and rs1006026 AA/GA/GG genotypes (FIG. 6A), rs911605AA and rs1006026 GA/GG genotypes (FIG. 6B), and rs911605AA and rs1006026 GG genotypes (FIG. 6C).
Figure 6B:
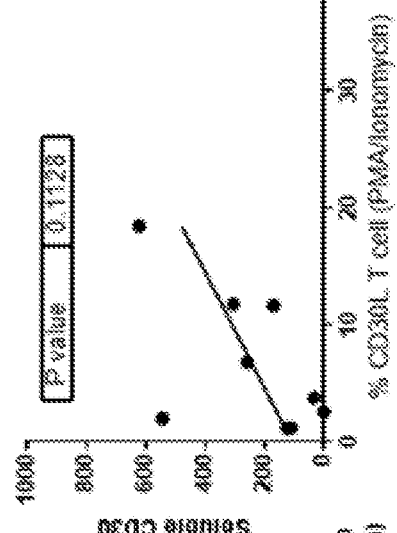
Figure 6C:
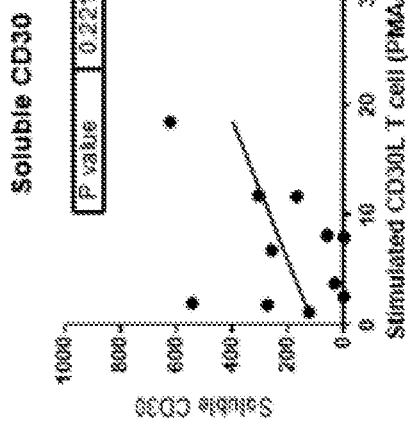

Example 4. Soluble CD30 (sCD30) Levels Correlate with CD30L Expression on T and B Cells in Subject Carrying Refined Patient Selection Genotypes PBMC were stimulated in vitro under conditions that would up-regulate either CD30L (phorbol 12-myristate 13-acetate (PMA) and ionomycin) or CD30 (anti-CD3 antibody and anti-CD28 antibody) for 72 hours. Supernatants were collected for analysis of sCD30 at 72, hours and cells were collected after 72 hours and analyzed for expression of CD30 and CD30L by flow cytometry. Analysis showed that sCD30 levels correlate with CD30L expression on T and B cells in the genetically refined patient population (rs9 11605AA+rs1006026GG). FIG. 6A shows sCD30 levels correlate with CD30L expression on T cells in the genetically refined patient population defined by rs911605AA+ rs1006026AA/GA/GG. FIG. 6B shows sCD30 levels correlate with CD30L expression on T cells in the genetically refined patient population defined by rs911605AA+ rs1006026GA/GG. FIG. 6C shows sCD30 levels correlate with CD30L expression on T cells in the genetically refined patient population defined by rs911605AA+rs1006026GG. FIG. 7A shows sCD30 levels correlate with CD30L expression on B cells in the genetically refined patient population defined by rs911605AA+rs1006026AA/GA/GG. FIG. 7B shows sCD30 levels correlate with CD30L expression on B cells in the genetically refined patient population defined by rs911605AA+rs1006026GA/GG. FIG. 7C shows sCD30 levels correlate with CD30L expression on B cells in the genetically refined patient population defined by rs911605AA+rs1006026GG.

Example 5. Polymorphisms Associated with Subclinical Phenotypes of Inflammatory Bowel Disease (Cedars-Sinai Cohort)

Patients with IBD were recruited at the Cedars-Sinai Inflammatory Bowel Disease Centers. The diagnosis of each patient was based on standard endoscopic, histologic, and radiographic features. Blood samples were collected from patients at the time of enrollment. Blood samples were also collected from individuals without IBD. Genotyping was performed at Cedars-Sinai Medical Center using Illumina whole-genome arrays per manufacturer's protocol (Illumina, San Diego, Calif.) on all samples collected. Markers/SNPs were excluded from analysis if there were deviations in Hardy-Weinberg Equilibrium in controls with p≤0.0001; missingness in SNPs>2% and minor allele frequency <1%. Related individuals (Pi-hat scores >0.25) were identified using identity-by-descent and excluded from analysis (PLINK). Admixture was used to generate ethnicity proportion estimations for all individuals. Only subjects identified by admixture as Caucasian (proportion <0.75) were included in the analysis.

Polymorphisms Associated with Serologies

Serum samples were obtained from all patients and tested for the presence of antibodies against *Saccharomyces cerevisiae* (ASCA), and Cbir1 flagellin. Genotyping was performed at Cedars-Sinai Medical Center using Illumina whole-genome arrays per manufacturer's protocol (Illumina, San Diego, Calif.) on blood samples collected from the patients. The results showed, provided in Table 6, polymorphisms significantly associated with a presence of ASCA in patients diagnosed with ulcerative colitis. The results also showed, as provided in Table 7, polymorphisms significantly associated with a presence of anti-Cbir1 antibodies in patients diagnosed with ulcerative colitis.

Polymorphisms Associated with Loss of Response to an Anti-TNF Therapy

Genotyping was performed Cedars-Sinai Medical Center using Illumina whole-genome arrays per manufacturer's protocol (Illumina, San Diego, Calif.) on blood samples collected from the patients with UC (n=99) who suffer from secondary loss of response to an anti-TNF therapy. Secondary non-response, or "loss-of-response," refers to the loss of response during maintenance after a successful induction of the anti-TNF therapy. Table 4 provides a list of polymorphisms associated with a loss of response to an anti-TNF therapy in patients with UC.

Polymorphisms Associated with Primary Sclerosing Cholangitis

Genotyping was performed Cedars-Sinai Medical Center using Illumina whole-genome arrays per manufacturer's protocol (Illumina, San Diego, Calif.) on blood samples collected from the patients with UC (n=115) who suffer from primary sclerosing cholangitis (PSC). Table 5 provides a list of polymorphisms associated with a PSC in patients with UC.

Polymorphisms Associated with a Time to First Surgery and a Time to Second Surgery Genotyping was performed Cedars-Sinai Medical Center using Illumina whole-genome arrays per manufacturer's protocol (Illumina, San Diego, Calif.) on blood samples collected from the patients with CD (n=1091) who underwent a First Surgery, usually a small bowel resection. Genotyping was performed on blood samples collected from the patients with UC (n=181) who underwent a Second Surgery. A First Surgery is defined as a time between a first diagnosis of CD and a time of a first surgical intervention to treat the CD. A Second Surgery is defined as a time between the First Surgery and a second surgical intervention to treat the CD. Table 8 and 9 provides a list of polymorphisms associated with a faster time to a First Surgery, an a faster time to Second surgery, respectively, in patients with CD.

Polymorphisms Associated with Paneth Cell Defects

Genotyping was performed Cedars-Sinai Medical Center using Illumina whole-genome arrays per manufacturer's protocol (Illumina, San Diego, Calif.) on blood samples collected from the patients with CD with the DO (n=297), D1234 (n=297), D2 (n=297), D3 (n-297), and D5 (n=155), Paneth cell phenotypes as determined by VanDussen et al., Genetic Variants Synthesize to Produce Paneth Cell Phenotypes That Define Subtypes of Crohn's Disease, Gastroenterology 2014; 146:200-209. Table 10 provides a list of polymorphisms associated with the above Paneth cell phenotypes in patients with CD.

Polymorphisms Associated with Thrombus Development

Genotyping was performed Cedars-Sinai Medical Center using Illumina whole-genome arrays per manufacturer's protocol (Illumina, San Diego, Calif.) on blood samples collected from the patients with UC (n=116) with thrombus formation. Table 11 provides a list of polymorphisms associated with the above thrombus formation in patients with US.

Polymorphisms Associated with Stricturing and/or Penetrating Disease

Genotyping was performed Cedars-Sinai Medical Center using Illumina whole-genome arrays per manufacturer's protocol (Illumina, San Diego, Calif.) on blood samples collected from the patients with CD with non-stricturing and non-penetrating disease in the ileum of the small intestine (n=2906), stricturing and penetrating disease in the ileum (n=6002), and stricturing and penetrating disease in the ileocolonic region of the intestine (n=6064). Table 12 provides a list of polymorphisms associated with stricturing and/or penetrating disease in patients with CD.

Example 6. Genotyping by Quantitative Polymerase Chain Reaction (qPCR)

The presence or absence of rs911605A genotype in a subject is performed by quantitative polymerase chain reaction (qPCR). Optionally the presence or absence of rs1006026G in the subject is performed by qPCR. The subject presents with obstructive Crohn's disease.

Genomic DNA is purified from a serum sample of the subject. The DNA is aliquoted into a well of a PCR plate or a PCR tube. A mixture comprising primers (SEQ ID NOS: 9, 10), and optionally, (SEQ ID NOS:11, 12) and TaqMan master mix is prepared, and an aliquot of the mixture is added to the PCR well or tube comprising DNA. qPCR is performed as follows: 95° C. for 10 minutes; 40 cycles of 95° C. for 0.15 seconds and 60° C. for 1 minute; and hold at 4° C. The reporter dye is FAM, and the quenching dye is MGB-NFQ.

The number of cycles required to reach the cycle threshold (Ct) is evaluated, where Ct values below 30 cycles indicate presence of the genotype. The subject has a Ct value below 30 cycles.

Example 7. Treatment with Anti-CD30L Antibody

The subject having the presence of rs911605A genotype of Example 3 is treated with an anti-CD30L antibody selected from: an antibody comprising a HC variable domain comprising SEQ ID NO: 136 and a LC variable domain comprising SEQ ID NO: 137, a HC variable domain comprising SEQ ID NO: 138 and a LC variable domain comprising SEQ ID NO: 139, a HC variable domain comprising SEQ ID NO: 140 and a LC variable domain comprising SEQ ID NO: 141, a HC variable domain comprising SEQ ID NO: 142 and a LC variable domain comprising SEQ ID NO: 143, a HC variable domain comprising SEQ ID NO: 144 and a LC variable domain comprising SEQ ID NO: 145, a HC variable domain comprising SEQ ID NO: 146 and a LC variable domain comprising SEQ ID NO: 154, a HC variable domain comprising SEQ ID NO: 147 and a LC variable domain comprising SEQ ID NO: 154, a HC variable domain comprising SEQ ID NO: 148 and a LC variable domain comprising SEQ ID NO: 154, a HC variable domain comprising SEQ ID NO: 149 and a LC variable domain comprising SEQ ID NO: 154, a HC variable domain comprising SEQ ID NO: 150 and a LC variable domain comprising SEQ ID NO: 154, a HC variable domain comprising SEQ ID NO: 151 and a LC variable domain comprising SEQ ID NO: 154, a HC variable domain comprising SEQ ID NO: 152 and a LC variable domain comprising SEQ ID NO: 154, and a HC variable domain comprising SEQ ID NO: 153 and a LC variable domain comprising SEQ ID NO: 154.

Example 8. Quantification of Soluble CD30

The quantity of soluble CD30 is determined from a sample of serum from a subject. The assay employs an antibody specific for human CD30 coated on a 96-well plate. Standards and the sample from the subject are pipetted into the wells and CD30 present in a sample is bound to the wells by the immobilized antibody. The wells are washed and biotinylated anti-Human CD30 antibody is added. After washing away unbound biotinylated antibody, HRP-conjugated streptavidin is pipetted to the wells. The wells are again washed, a TMB substrate solution is added to the wells and color develops in proportion to the amount of CD30 bound. The Stop Solution changes the color from blue to yellow, and the intensity of the color is measured at 450 nm. The quantity of CD30 in the sample from the subject is determined by comparison to a standard curve. The subject is treated if he has an elevated level of CD30, which may be defined by +2 standard deviation above the mean for a control derived from a non-diseased individual, or population of non-diseased individuals.

Example 9. Treatment with Anti-CD30L Antibody

The subject having elevated CD30 is treated with an anti-CD30L antibody selected from: an antibody comprising a HC variable domain comprising SEQ ID NO: 136 and a LC variable domain comprising SEQ ID NO: 137, a HC variable domain comprising SEQ ID NO: 138 and a LC variable domain comprising SEQ ID NO: 139, a HC variable domain comprising SEQ ID NO: 140 and a LC variable domain comprising SEQ ID NO: 141, a HC variable domain comprising SEQ ID NO: 142 and a LC variable domain comprising SEQ ID NO: 143, a HC variable domain comprising SEQ ID NO: 144 and a LC variable domain comprising SEQ ID NO: 145, a HC variable domain comprising SEQ ID NO: 146 and a LC variable domain comprising SEQ ID NO: 154, a HC variable domain comprising SEQ ID NO: 147 and a LC variable domain comprising SEQ ID NO: 154, a HC variable domain comprising SEQ ID NO: 148 and a LC variable domain comprising SEQ ID NO: 154, a HC variable domain comprising SEQ ID NO: 149 and a LC variable domain comprising SEQ ID NO: 154, a HC variable domain comprising SEQ ID NO: 150 and a LC variable domain comprising SEQ ID NO: 154, a HC variable domain comprising SEQ ID NO: 151 and a LC variable domain comprising SEQ ID NO: 154, a HC variable domain comprising SEQ ID NO: 152 and a LC variable domain comprising SEQ ID NO: 154, and a HC variable domain comprising SEQ ID NO: 153 and a LC variable domain comprising SEQ ID NO: 154.

Example 10. Phase 1A Clinical Trial

A phase 1 clinical trial is performed to evaluate the safety, tolerability, pharmacokinetics and pharmacodynamics of an anti-CD30L antibody in subjects having rs911605A positive Crohn's disease (carrier of "A" at position 501 of SEQ ID NO: 1).

Single ascending dose (SAD) arms: Subjects in each group (subjects are grouped based on the presence or absence of rs911605A genotype) receive either a single dose of the antibody or a placebo. Exemplary doses are 1, 3, 10, 30, 100, 300, 600 and 800 mg of antibody. Safety monitoring and PK assessments are performed for a predetermined time. Based on evaluation of the PK data, and if the antibody is deemed to be well tolerated, dose escalation occurs, either within the same groups or a further group of healthy subjects. Dose escalation continues until the maximum dose has been attained unless predefined maximum exposure is reached or intolerable side effects become apparent.

Multiple ascending dose (MAD) arms: Subjects in each group (subjects are grouped based on the presence or absence of rs911605A genotype) receive multiple doses of the antibody or a placebo. The dose levels and dosing intervals are selected as those that are predicted to be safe from the SAD data. Dose levels and dosing frequency are chosen to achieve therapeutic drug levels within the systemic circulation that are maintained at steady state for several days to allow appropriate safety parameters to be monitored. Samples are collected and analyzed to determination PK profiles.

Inclusion Criteria: Subjects of non-childbearing potential between the ages of 18 and 55 years having obstructive Crohn's disease. Female subjects of non-childbearing potential must meet at least one of the following criteria: (1) achieved postmenopausal status, defined as: cessation of regular menses for at least 12 consecutive months with no alternative pathological or physiological cause; and have a serum follicle stimulating hormone (FSH) level within the laboratory's reference range for postmenopausal females; (2) have undergone a documented hysterectomy and/or bilateral oophorectomy; (3) have medically confirmed ovarian failure. All other female subjects (including females with tubal ligations and females that do not have a documented hysterectomy, bilateral oophorectomy and/or ovarian failure) will be considered to be of childbearing potential. Body Mass Index (BMI) of 17.5 to 30.5 kg/m2; and a total body weight >50 kg (110 lbs). Evidence of a personally signed and dated informed consent document indicating that the subject (or a legal representative) has been informed of all pertinent aspects of the study.

Two groups of subjects are selected: subjects having rs911605A genotype, and subjects lacking the genotype.

Exclusion Criteria: Evidence or history of clinically significant hematological, renal, endocrine, pulmonary, gastrointestinal, cardiovascular, hepatic, psychiatric, neurologic, or allergic disease (including drug allergies, but excluding untreated, asymptomatic, seasonal allergies at time of dosing) or than Crohn's disease. Subjects with a history of or current positive results for any of the following serological tests: Hepatitis B surface antigen (HBsAg), Hepatitis B core antibody (HBcAb), anti-Hepatitis C antibody (HCV Ab) or human immunodeficiency virus (HIV). Subjects with a history of allergic or anaphylactic reaction to a therapeutic drug. Treatment with an investigational drug within 30 days (or as determined by the local requirement, whichever is longer) or 5 half-lives or 180 days for biologics preceding the first dose of study medication. Pregnant females; breast-feeding females; and females of childbearing potential.

Primary Outcome Measures: Incidence of dose limiting or intolerability treatment related adverse events (AEs) [Time Frame: 12 weeks]. Incidence, severity and causal relationship of treatment emergent AEs (TEAEs) and withdrawals due to treatment emergent adverse events [Time Frame: 12 weeks]. Incidence and magnitude of abnormal laboratory findings [Time Frame: 12 weeks]. Abnormal and clinically relevant changes in vital signs, blood pressure (BP) and electrocardiogram (ECG) parameters [Time Frame: 12 weeks].

Secondary Outcome Measures:

Single Ascending Dose: Maximum Observed Plasma Concentration (Cmax) [Time Frame: 12 weeks]. Single Ascending Dose: Time to Reach Maximum Observed Plasma Concentration (Tmax) [Time Frame: 12 weeks]. Single Ascending Dose: Area under the plasma concentration-time profile from time zero to 14 days (AUC14 days) [Time Frame: 12 weeks]. Single Ascending Dose: Area under the plasma concentration-time profile from time zero extrapolated to infinite time (AUCinf) [Time Frame: 12 weeks]. Single Ascending Dose: Area under the plasma concentration-time profile from time zero to the time of last quantifiable concentration (AUClast) [Time Frame: 12 weeks]. Single Ascending Dose: Dose normalized maximum plasma concentration (Cmax[dn]) [Time Frame: 12 weeks]. Single Ascending Dose: Dose normalized area under the plasma concentration-time profile from time zero extrapolated to infinite time (AUCinf[dn]) [Time Frame: 12 weeks]. Single Ascending Dose: Dose normalized area under the plasma concentration-time profile from time zero to the time of last quantifiable concentration (AUClast[dn]) [Time Frame: 12 weeks]. Single Ascending Dose: Plasma Decay Half-Life (t/2) [Time Frame: 12 weeks]. Plasma decay half-life is the time measured for the plasma concentration to decrease by one half. Single Ascending Dose: Mean residence time (MRT) [Time Frame: 12 weeks]. Single Ascending Dose: Volume of Distribution at Steady State (Vss) [Time Frame: 6 weeks]. Volume of distribution is defined as the theoretical volume in which the total amount of drug would need to be uniformly distributed to produce the desired blood concentration of a drug. Steady state volume of distribution (Vss) is the apparent volume of distribution at steady-state. Single Ascending Dose: Systemic Clearance (CL) [Time Frame: 6]. CL is a quantitative measure of the rate at which a drug substance is removed from the body.

Multiple Ascending Dose First Dose: Maximum Observed Plasma Concentration (Cmax) [Time Frame: 12 weeks]. Multiple Ascending Dose First Dose: Time to Reach Maximum Observed Plasma Concentration (Tmax) [Time Frame: 12 weeks]. Multiple Ascending Dose First Dose: Area under the plasma concentration-time profile from time zero to time x, the dosing interval where τ=2 weeks (AUCτ) [Time Frame: 12 weeks]. Multiple Ascending Dose First Dose: Dose normalized maximum plasma concentration (Cmax[dn]) [Time Frame: 12 weeks]. Multiple Ascending Dose First Dose: Dose normalized Area under the plasma concentration-time profile from time zero to time r, the dosing interval where τ=2 weeks (AUCt [dn]) [Time Frame: 12 weeks]. Plasma Decay Half-Life (t/2) [Time Frame: 12 weeks]. Plasma decay half-life is the time measured for the plasma concentration to decrease by one half. Multiple Ascending Dose First Dose: Mean residence time (MRT) [Time Frame: 12 weeks]. Apparent Volume of Distribution (Vz/F) [Time Frame: 12 weeks]. Volume of distribution is defined as the theoretical volume in which the total amount of drug would need to be uniformly distributed to produce the desired plasma concentration of a drug. Apparent volume of distribution after oral dose (Vz/F) is influenced by the fraction absorbed. Multiple Ascending Dose First Dose: Volume of Distribution at Steady State (Vss) [Time Frame: 12 weeks]. Volume of distribution is defined as the theoretical volume in which the total amount of drug would need to be uniformly distributed to produce the desired blood concentration of a drug. Steady state volume of distribution (Vss) is the apparent volume of distribution at steady-state. Multiple Ascending Dose First Dose: Apparent Oral Clearance (CL/F) [Time Frame: 12 weeks]. Clearance of a drug is a measure of the rate at which a drug is metabolized or eliminated by normal biological processes. Clearance obtained after oral dose (apparent oral clearance) is influenced by the fraction of the dose absorbed. Clearance is estimated from population pharmacokinetic (PK) modeling. Drug clearance is a quantitative measure of the rate at which a drug substance is removed from the blood. Multiple Ascending Dose First Dose: Systemic Clearance (CL) [Time Frame: 12 weeks]. CL is a quantitative measure of the rate at which a drug substance is removed from the body.

Multiple Ascending Dose Multiple Dose: Maximum Observed Plasma Concentration (Cmax) [Time Frame: 12 weeks]. Multiple Ascending Dose Multiple Dose: Time to Reach Maximum Observed Plasma Concentration (Tmax) [Time Frame: 12 weeks]. Multiple Ascending Dose Multiple Dose: Area under the plasma concentration-time profile from time zero to time c, the dosing interval where τ=2 weeks (AUCτ) [Time Frame: 12 weeks]. Multiple Ascending Dose Multiple Dose: Dose normalized maximum plasma concentration (Cmax[dn]) [Time Frame: 12 weeks]. Multiple Ascending Dose Multiple Dose: Dose normalized Area under the plasma concentration-time profile from time zero to time τ, the dosing interval where c=2 weeks (AUCt [dn]) [Time Frame: 12 weeks]. Multiple Ascending Dose Multiple Dose: Plasma Decay Half-Life (t½) [Time Frame: 12 weeks]. Plasma decay half-life is the time measured for the plasma concentration to decrease by one half. Multiple Ascending Dose Multiple Dose: Apparent Volume of Distribution (Vz/F) [Time Frame: 12 weeks]. Volume of distribution is defined as the theoretical volume in which the total amount of drug would need to be uniformly distributed to produce the desired plasma concentration of a drug. Apparent volume of distribution after oral dose (Vz/F) is influenced by the fraction absorbed. Multiple Ascending Dose Multiple Dose: Volume of Distribution at Steady State (Vss) [Time Frame: 12 weeks]. Volume of distribution is defined as the theoretical volume in which the total amount of drug would need to be uniformly distributed to produce the desired blood concentration of a drug. Steady state volume of distribution (Vss) is the apparent volume of distribution at steady-state.

Multiple Ascending Dose Multiple Dose: Apparent Oral Clearance (CL/F) [Time Frame: 12 weeks]. Clearance of a drug is a measure of the rate at which a drug is metabolized or eliminated by normal biological processes. Clearance obtained after oral dose (apparent oral clearance) is influenced by the fraction of the dose absorbed. Clearance was estimated from population pharmacokinetic (PK) modeling. Drug clearance is a quantitative measure of the rate at which a drug substance is removed from the blood. Multiple Ascending Dose Multiple Dose: Systemic Clearance (CL) [Time Frame: 12 weeks]. CL is a quantitative measure of the rate at which a drug substance is removed from the body. Multiple Ascending Dose Multiple Dose: Minimum Observed Plasma Trough Concentration (Cmin) [Time Frame: 12 weeks]. Multiple Ascending Dose Multiple Dose: Average concentration at steady state (Cav) [Time Frame: 12 weeks]. Multiple Ascending Dose Multiple Dose: Observed accumulation ratio (Rae) [Time Frame: 12 weeks]. Multiple Ascending Dose Multiple Dose: Peak to trough fluctuation (PTF) [Time Frame: 12 weeks]. Multiple Ascending Dose Additional Parameter: estimate of bioavailability (F) for subcutaneous administration at the corresponding intravenous dose [Time Frame: 12 weeks]. Immunogenicity for both Single Ascending Dose and Multiple Ascending Dose: Development of anti-drug antibodies (ADA) [Time Frame: 12 weeks].

Example 11: Phase 1B Clinical Trial

A phase 1b open label clinical trial is performed to evaluate efficacy of an anti-CD30L antibody on patients having a rs911605A genotype (carrier of "A" at position 501 of SEQ ID NO: 1) and obstructive Crohn's disease.

Arms: 10 patients positive for rs911605A are administered the antibody. 5-10 patients negative for rs911605A are administered the antibody. Patients are monitored in real-time. Central ready of endoscopy and biopsy is employed, with readers blinded to point of time of treatment and endpoints.

Inclusion Criteria: Two groups of subjects are selected: subjects having rs911605A genotype, and subjects lacking rs911605A genotype.

Primary Outcome Measures: Simple Endoscopic Score for Crohn's Disease (SESCD), Crohn's Disease Activity Index (CDAI), and Patient Reported Outcome (PRO). If the rs911605A genotype positive group shows 50% reduction from baseline, a Phase 2a clinical trial is performed.

Inclusion Criteria: PRO entry criteria: Abdominal pain score of 2 or more and/or stool frequency score of 4 or more. Primary outcome would be pain core of 0 or 1 and stool frequency score of 3 or less with no worsening from baseline. Endoscopy entry criteria: SESCD ileum only entry at score of 4 and 6 if colon is involved. Primary endoscopic outcome is 40-50% delta of mean SESCD.

Example 12: Phase 2A Clinical Trial

A phase 2a clinical trial is performed to evaluate efficacy of an anti-CD30L antibody on patients having a rs911605A genotype (carrier of "A" at position 501 of SEQ ID NO: 1) and obstructive Crohn's disease.

Arms: 40 patients per arm (antibody and placebo arms) are treated with antibody or placebo for 12 weeks. An interim analysis is performed after 20 patients from each group are treated at the highest dose to look for a 40-50% delta between placebo and treated group in primary outcome (50% reduction from baseline in SESCD, CDAI, and PRO).

Primary Outcome Measures: Simple Endoscopic Score for Crohn's Disease (SESCD), Crohn's Disease Activity Index (CDAI), and Patient Reported Outcome (PRO).

Inclusion Criteria: PRO entry criteria: Abdominal pain score of 2 or more and/or stool frequency score of 4 or more. Primary outcome would be pain core of 0 or 1 and stool frequency score of 3 or less with no worsening from baseline. Endoscopy entry criteria: SESCD ileum only entry at score of 4 and 6 if colon is involved. Primary endoscopic outcome is 40-50% delta of mean SESCD.

While preferred embodiments have been shown and described herein, it will be obvious to those skilled in the art that such embodiments are provided by way of example only. Numerous variations, changes, and substitutions will occur to those skilled in the art without departing from the scope of this application. Various alternatives to the embodiments described herein may be employed in practicing the scope of this application.

SEQUENCE LISTING (200291 sequences)

SEQ ID NO: 1 - DNA, 1001 bp, Homo sapiens
attaaaattatgtctgatagtatattttcagaagtctgggtaattcagtctagagaatagctatatatgaggttttgtgatttattagaatccacttaagttcccttttttcatatccttctttttttatttttattttttattttagatggagtttcgctgttgttgtctgggctggagtgcaatggcgcaatctcgcctcacttcactgcatcctctgcctcctgggttcaagtgattctcctgcctcagcctcccaagtagctgggattacaggcgtgtgccaccatgctttgctaattttgtatttttttttttttagtagagatgaggtttcaccatgttggtcaggctagtctcaaactcctgacctcaagtgatccacctgcctcggcctcctaaagtgctgggattacagatgtgagccactgtgcccggcctcatatccttttaaggcaccatctggtctcttctaaactcccttgagtggttgattgaagraaaacatctaagaacaaataattttcttggaacagtacattctaagtctatattttagagacattttgattaaaattattttcattattatgaagacattcaaatcctcacatgtctctggtttactggttgtaaagaaaaaaatcctcacatctctaacctccttattttaaaacatgatctttttggaagctattcctttctcactgcttttggtggatttgcctctgaggccttttcttttttaagtttactacttcttcatattgttggatagatattatcaagtccatggtcaaaaatcatgcattagcccatggaatcccttagcactcagaggcatgttctatacatgattccaacaaagttggtactcccctctcacagctgacaatattgaaaaggtcagatagacagtgatcatatggttctctttgtgggaaaatttatgatgtatgtgtgtgtgtgtgttgtaagtgtgtatatctaaacatacctgg

SEQ ID NO: 2 - DNA, 1001 bp, Homo sapiens
attaaaattatgtctgatagtatattttcagaagtctgggtaattcagtctagagaatagctatatatgaggttttgtgatttattagaatccacttaagttcccttttttcatatccttctttttttatttttattttttattttagatggagtttcgctgttgttgtctgggctggagtgcaatggcgcaatctcgcctcacttcactgcatcctctgcctcctgggttcaagtgattctcctgcctcagcctcccaagtagctgggattacaggcgtgtgccaccatgctttgctaattttgtatttttttttttttagtagagatgaggtttcaccatgttggtcaggctagtctcaaactcctgacctcaagtgatccacctgcctcggcctcctaaagtgctgggattacagatgtgagccactgtgcccggcctcatatccttttaaggcaccatctggtctcttctaaactcccttgagtggttgattgaagaaaaacatctaagaacaaataattttcttggaacagtacattctaagtctatattttagagacattttgattaaaattattttcattattatgaagacattcaaatcctcacatgtctctggtttactggttgtaaagaaaaaaatcctcacatctctaacctccttattttaaaacatgatctttttggaagctattcctttctcactgcttttggtggatttgcctctgaggccttttcttttttaagtttactacttcttcatattgttggatagatattatcaagtccatggtcaaaaatcatgcattagcccatggaatcccttagcactcagaggcatgttctatacatgattccaacaaagttggtactcccctctcacagctgacaatattgaaaaggtcagatagacagtgatcatatggttctctttgtgggaaaatttatgatgtatgtgtgtgtgtgtgttgtaagtgtgtatatctaaacatacctgg

SEQ ID NO: 3 - DNA, 1001 bp, Homo sapiens
  modified_base (501)..(501): a, c, t, g, unknown or other
ttatatatcaccatcgccacccatttttccaccatctctctctctctctcagcagttctagttggatcctttaactaaagaacttcttaaaggacacttcaatttcttttctttggccattgctataaaatgacatacccttggttcactccaaattagaattacagaaattgcagagcccctgcagaagaaaagatgtcctaaagtgttttcaagattattatacttaatagatgtagataagccattaaattatgagttttaagaattccactatctaaatcaaatatttgcaactccttcttttcacttttgtagagatatgagcttcaaagcttccatttaatttcaaagcttgatgacacttgagaaatagatatcaaagccttttaaagcctagttctttccagcaattgataagctatagagtacttggcctaagaaaactgaagaaaaaccagaataaattcagcaggattataataccacgaaaagtaggcnctatgaagtaagaaacagaaatattctcactttggcaggtcatgtgggtgggtgcagctcttaaattacccattaacaacttcatcaaaaaattcatgagcaatatatgctattactacagcattttctatataatatatactggtagattctctgtaaacaccaattttctaaaatatgaagaagcttcctctttctcctcctcttctgttttcagaaacaaatcttaccatttacttcaaagtaaatctccgaagacagtctgaccctgtacagtgtgtacccaacgattgcttagtattgtgaggaacatcagagagaacaggtgctaaaaacctttcaactttctgcttctatgtgctgtttcttttttttttttttttgtgacgccctaacttcttcaaagttgtggcttaagaggaagctttcgatttgtcttgctggctttaacaccaaaatgtccaaagctctaagaagccatggtcttctctttcgcctcc

SEQ ID NO: 4 - DNA, 1001 bp, Homo sapiens
ttatatatcaccatcgccacccatttttccaccatctctctctctctctcagcagttctagttggatcctttaactaaagaacttcttaaaggacacttcaatttcttttctttggccattgctataaaatgacatacccttggttcactccaaattagaattacagaaattgcagagcccctgcagaagaaaagatgtcctaaagtgttttcaagattattatacttaatagatgtagataagccattaaattatgagttttaagaattccactatctaaatcaaatatttgcaactccttcttttcacttttgtagagatatgagcttcaaagcttccatttaatttcaaagcttgatgacacttgagaaatagatatcaaagccttttaaagcctagttctttccagcaattgataagctatagagtacttggcctaagaaaactgaagaaaaaccagaataaattcagcaggattataataccacgaaaagtaggcgctatgaagtaagaaacagaaatattctcactttggcaggtcatgtgggtgggtgcagctcttaaattacccattaacaacttcatcaaaaaattcatgagcaatatatgctattactacagcattttctatataatatatactggtagattctctgtaaacaccaattttctaaaatatgaagaagcttcctctttctcctcctcttctgttttcagaaacaaatcttaccatttacttcaaagtaaatctccgaagacagtctgaccctgtacagtgtgtacccaacgattgcttagtattgtgaggaacatcagagagaacaggtgctaaaaacctttcaactttctgcttctatgtgctgtttcttttttttttttttttgtgacgccctaacttcttcaaagttgtggcttaagaggaagctttcgatttgtcttgctggctttaacaccaaaatgtccaaagctctaagaagccatggtcttctctttcgcctcc

SEQ ID NO: 5 - DNA, 51 bp, Homo sapiens
aactcccttgagtggttgattgaagraaaacatctaagaacaaataatttt

SEQ ID NO: 6 - DNA, 51 bp, Homo sapiens
aaaattatttgttcttagatgttttrcttcaatcaaccactcaagggagtt

SEQ ID NO: 7 - DNA, 51 bp, Homo sapiens
gattataataccacgaaaagtaggcrctatgaagtaagaaacagaaatatt

SEQ ID NO: 8 - DNA, 51 bp, Homo sapiens
aatatttctgtttcttacttcatagrgcctacttttcgtggtattataatc

SEQ ID NO: 9 - DNA, 22 bp, Artificial Sequence
  Description of Artificial Sequence: Synthetic oligonucleotide
cctcctaaagtgctgggattac

SEQ ID NO: 10 - DNA, 22 bp, Artificial Sequence
  Description of Artificial Sequence: Synthetic oligonucleotide
accagagacatgtgaggatttg

SEQ ID NO: 11 - DNA, 25 bp, Artificial Sequence
  Description of Artificial Sequence: Synthetic oligonucleotide
aagcttgatgacacttgagaaatag

SEQ ID NO: 12 - DNA, 21 bp, Artificial Sequence
  Description of Artificial Sequence: Synthetic oligonucleotide
actaagcaatcgttgggtaca

SEQ ID NO: 13 - DNA, 101 bp, Artificial Sequence
  Description of Artificial Sequence: Synthetic polynucleotide
ttaaggcaccatctggtctcttctaaactcccttgagtggttgattgaagaaaaacatctaagaacaaataattttcttggaacagtacattctaagtcta

SEQ ID NO: 14 - DNA, 101 bp, Artificial Sequence
  Description of Artificial Sequence: Synthetic polynucleotide
tagacttagaatgtactgttccaagaaaattatttgttcttagatgtttttcttcaatcaaccactcaagggagtttagaagagaccagatggtgccttaa

SEQ ID NO: 15 - DNA, 101 bp, Artificial Sequence
  Description of Artificial Sequence: Synthetic polynucleotide
agaaaaaccagaataaattcagcaggattataataccacgaaaagtaggcgctatgaagtaagaaacagaaatattctcactttggcaggtcatgtgggtg

SEQ ID NO: 16 - DNA, 101 bp, Artificial Sequence
  Description of Artificial Sequence: Synthetic polynucleotide
cacccacatgacctgccaaagtgagaatatttctgtttcttacttcatagcgcctacttttcgtggtattataatcctgctgaatttattctggtttttct

SEQ ID NO: 17-99 - skipped (83 entries)

SEQ ID NO: 100 - protein, 5 aa, Homo sapiens
SYIWS

SEQ ID NO: 101 - protein, 16 aa, Homo sapiens
RIYASGNTNYNPSLKS

SEQ ID NO: 102 - protein, 16 aa, Homo sapiens
DYRVAGTYYYYYGLDV

SEQ ID NO: 103 - protein, 14 aa, Homo sapiens
TGTSSDVGVYDYVS

SEQ ID NO: 104 - protein, 7 aa, Homo sapiens
EVSNRPS

SEQ ID NO: 105 - protein, 10 aa, Homo sapiens
SSYTSRSTWV

SEQ ID NO: 106 - protein, 5 aa, Homo sapiens
SYYWT

SEQ ID NO: 107 - protein, 16 aa, Homo sapiens
RIYTSGITNYNPSLKS

SEQ ID NO: 108 - protein, 16 aa, Homo sapiens
ERVVGASRYYYYGVDV

SEQ ID NO: 109 - protein, 14 aa, Homo sapiens
TGTSSDVGLYNYVS

SEQ ID NO: 110 - protein, 7 aa, Homo sapiens
EVNNRPS

SEQ ID NO: 111 - protein, 10 aa, Homo sapiens
SSYTSSSTWV

SEQ ID NO: 112 - protein, 5 aa, Homo sapiens
SYYWT

SEQ ID NO: 113 - protein, 16 aa, Homo sapiens
RIYTSGITNYNPSLKS

SEQ ID NO: 114 - protein, 16 aa, Homo sapiens
ERVVGASRYYYYGVDV

SEQ ID NO: 115 - protein, 14 aa, Homo sapiens
TGTSSDIGLYDYVS

SEQ ID NO: 116 - protein, 7 aa, Homo sapiens
EVNNRPS

SEQ ID NO: 117 - protein, 10 aa, Homo sapiens
SSYTSSSTWV

SEQ ID NO: 118 - protein, 5 aa, Homo sapiens
SYSWS

SEQ ID NO: 119 - protein, 16 aa, Homo sapiens
RTSTSGRNNYNPSLKS

SEQ ID NO: 120 - protein, 16 aa, Homo sapiens
DFTIAARRYYYYGMDV

SEQ ID NO: 121 - protein, 14 aa, Homo sapiens
TGTSSDIGLYNYVS

SEQ ID NO: 122 - protein, 7 aa, Homo sapiens
EVINRPS

SEQ ID NO: 123 - protein, 10 aa, Homo sapiens
SSYTSSSTWV

SEQ ID NO: 124 - protein, 5 aa, Homo sapiens
NNYWS

SEQ ID NO: 125 - protein, 16 aa, Homo sapiens
RVYSSGLTNYKPSLKS

SEQ ID NO: 126 - protein, 16 aa, Homo sapiens
ERATVTTRYHYDGMDV

SEQ ID NO: 127 - protein, 14 aa, Homo sapiens
TGSSSDIGTYNYVS

SEQ ID NO: 128 - protein, 7 aa, Homo sapiens
EVNNRPS

SEQ ID NO: 129 - protein, 10 aa, Homo sapiens
SSYSSSSTWV

SEQ ID NO: 130 - protein, 5 aa, Homo sapiens
SYYWS

SEQ ID NO: 131 - protein, 16 aa, Homo sapiens
RIFASGSTNYNPSLRS

SEQ ID NO: 132 - protein, 16 aa, Homo sapiens
ERVGVQDYYHYSGMDV

SEQ ID NO: 133 - protein, 14 aa, Homo sapiens
TGTSSDVGLYNYVS

SEQ ID NO: 134 - protein, 7 aa, Homo sapiens
EVSKRPS

SEQ ID NO: 135 - protein, 10 aa, Homo sapiens
SSYTSSSTWV

SEQ ID NO: 136 - protein, 124 aa, Homo sapiens
QVQLQESGPGLVKPSETLSLTCTVSGGSISSYYWTWIRQPAGKGLEWIGRIYTSGITNYNPSLKSRVTMSVDTSKNQFSLKLSSVTAADTAVYYCARERVVGASRYYYYGVDVWGQGTTVTVSS

SEQ ID NO: 137 - protein, 110 aa, Homo sapiens
QSALTQPASVSGSPGQSITISCTGTSSDVGLYNYVSWYQQHPDKAPKLMIFEVNNRPSGVSNRFSGSNSGNTASLTISGLQAEDEADYYCSSYTSSSTWVFGGGTKLTVL

SEQ ID NO: 138 - protein, 124 aa, Homo sapiens; identical to SEQ ID NO: 136

SEQ ID NO: 139 - protein, 110 aa, Homo sapiens
QSALTQPASVSGSPGQSITISCTGTSSDIGLYDYVSWYQQHPDRAPKLIIFEVNNRPSGVSYRFSGSNSGNTASLTISGLQAEDEADYYCSSYTSSSTWVFGGGTKLTVL

SEQ ID NO: 140 - protein, 124 aa, Homo sapiens
QVQLQESGPGLVKPSETLSLTCTVSGGSISSYSWSWIRQPAGKGLEWIGRTSTSGRNNYNPSLKSRVTMSVDTSKNQFSLKLNSVTAADTAVYYCARDFTIAARRYYYYGMDVWGQGTTVTVSS

SEQ ID NO: 141 - protein, 110 aa, Homo sapiens
QSALTQPASVSGSPGQSITISCTGTSSDIGLYNYVSWYQQHPGKAPKLIIYEVINRPSGVSNRFSGSESGNTASLTISGLQAEDEANYYCSSYTSSSTWVFGGGTKLTVL

SEQ ID NO: 142 - protein, 124 aa, Homo sapiens
QVQLQESGPRLVKPSETLSLTCTVSGGSITNNYWSWIRQPAGKGLEWIGRVYSSGLTNYKPSLKSRVTMSVDTSKNQFSLRLNSVTAADTAVYYCARERATVTTRYHYDGMDVWGQGTSVTVSS

SEQ ID NO: 143 - protein, 110 aa, Homo sapiens
QSALTQPASVSGSPGQSITISCTGSSSDIGTYNYVSWYQQYPGKAPELMIYEVNNRPSGVSDRFSGSTSGNTASLTISGLQANDEADYYCSSYSSSSTWVFGGGTKLTVL

SEQ ID NO: 144 - protein, 124 aa, Homo sapiens
QVQLQESGPGLVKPSETLSLTCTVSGGSISSYYWSWIRQPAGKGLEWIGRIFASGSTNYNPSLRSRVTMSRDTSKNQFSLKLSSVTAADTAVYYCAKERVGVQDYYHYSGMDVWGQGTTVTVSS

SEQ ID NO: 145 - protein, 110 aa, Homo sapiens
QSALTQPASVSGSPGQSITISCTGTSSDVGLYNYVSWYQQQPGKAPKLMIYEVSKRPSGVSNRFSGSTSGNTASLTISGLQADDEADYSCSSYTSSSTWVFGGGTKLTVL

SEQ ID NO: 146 - protein, 124 aa, Homo sapiens
QVQLQESGPGLVKPSETLSLTCTVSGGSISSYIWSWIRQPAGKGLEWIGRIYASGNTNYNPSLKSRVTISVDTSKNQFSLKLSSMTAADTAVYYCARDYRVAGTYYYYYGLDVWGQGTTVTVSS

SEQ ID NO: 147 - protein, 124 aa, Homo sapiens
QVQLQESGPGLVKPSETLSLTCTVSGGSISSYIWSWIRQPAGKGLEWIGRIYASGNTNYNPSLKSRVTMSVDTSKNQFSLKLSSMTAADTAVYYCARDYRVAGTYYYYYGLDVWGQGTTVTVSS

SEQ ID NO: 148 - protein, 124 aa, Homo sapiens
QVQLQESGPGLVKPSETLSLTCTVSGGSISSYIWSWIRQPAGKGLEWIGRIYASGNTNYNPSLKSRVTMSVDTSKNQFSLKLSSVTAADTAVYYCARDYRVAGTYYYYYGLDVWGQGTTVTVSS

SEQ ID NO: 149 - protein, 124 aa, Homo sapiens
QVQLQESGPGLVKPSETLSLTCTVSGGSISSYIWSWIRQPAGKGLEWIGRIYASGQTNYNPSLKSRVTMSVDTSKNQFSLKLSSMTAADTAVYYCARDYRVAGTYYYYYGLDVWGQGTTVTVSS

SEQ ID NO: 150 - protein, 124 aa, Homo sapiens
QVQLQESGPGLVKPSETLSLTCTVSGGSISSYIWSWIRQPAGKGLEWIGRIYASGQTNYNPSLKSRVTISVDTSKNQFSLKLSSVTAADTAVYYCARDYRVAGTYYYYYGLDVWGQGTTVTVSS

SEQ ID NO: 151 - protein, 124 aa, Homo sapiens
QVQLQESGPGLVKPSETLSLTCTVSGGSISSYIWSWIRQPAGKGLEWIGRIYASGNTNYNPSLKSRVTISVDTSKNQFSLKLSSVTAADTAVYYCARDYRVAGTYYYYYGLDVWGQGTTVTVSS

SEQ ID NO: 152 - protein, 124 aa, Homo sapiens
QVQLQESGPGLVKPSETLSLTCTVSGGSISSYIWSWIRQPAGKGLEWIGRIYASGQTNYNPSLKSRVTISVDTSKNQFSLKLSSMTAADTAVYYCARDYRVAGTYYYYYGLDVWGQGTTVTVSS

SEQ ID NO: 153 - protein, 124 aa, Homo sapiens
QVQLQESGPGLVKPSETLSLTCTVSGGSISSYIWSWIRQPAGKGLEWIGRIYASGQTNYNPSLKSRVTMSVDTSKNQFSLKLSSVTAADTAVYYCARDYRVAGTYYYYYGLDVWGQGTTVTVSS

SEQ ID NO: 154 - protein, 110 aa, Homo sapiens
QSALTQPASVSGSPGQSITISCTGTSSDVGVYDYVSWYQQHPGKAPKLMIYEVSNRPSGVSNRFSGSKSGNTASLTISGLQTEDEADYYCSSYTSRSTWVFGGGTKLTVL

SEQ ID NO: 155-483 - skipped (329 entries)

SEQ ID NO: 484 - protein, 5 aa, Homo sapiens
DTYMH

SEQ ID NO: 485 - protein, 5 aa, Homo sapiens
PASGH

SEQ ID NO: 486 - protein, 6 aa, Homo sapiens
SGGLPD

SEQ ID NO: 487 - protein, 9 aa, Homo sapiens
ASSSVSYMY

SEQ ID NO: 488 - protein, 7 aa, Homo sapiens
ATSNLAS

SEQ ID NO: 489 - protein, 5 aa, Homo sapiens
GNPRT

SEQ ID NO: 490 - protein, 106 aa, Homo sapiens
EIVLTQSPGTLSLSPGERATLSCRASSSVSYMYWYQQKPGQAPRLLIYATSNLASGIPDRFSGSGSGTDFTLTISRLEPEDFAVYYCQQWSGNPRTFGGGTKLEIK

SEQ ID NO: 491 - protein, 116 aa, Homo sapiens
QVQLVQSGAEVKKPGASVKVSCKASGFDIQDTYMHWVRQAPGQGLEWMGRIDPASGHTKYDPKFQVRVTMTRDTSTSTVYMELSSLRSEDTAVYYCARSGGLPDVWGQGTTVTVSS

SEQ ID NO: 492 - protein, 106 aa, Homo sapiens
EIVLTQSPGTLSLSPGERATLSCRASSSVSYMYWYQQKPGQAPRLLIYATSNLASGIPDRFSGSGSGTDFTLTISRLEPEDFAVYYCQQWEGNPRTFGGGTKLEIK

SEQ ID NO: 493 - protein, 116 aa, Homo sapiens
QVQLVQSGAEVKKPGASVKVSCKASGFDIQDTYMHWVRQAPGQGLEWMGRIEPASGHIKYDPKFQGRVTMTRDTSTSTVYMELSSLRSEDTAVYYCARSGGLPDWWGQGTTVTVSS

SEQ ID NO: 494 - protein, 106 aa, Homo sapiens; identical to SEQ ID NO: 492

SEQ ID NO: 495 - protein, 116 aa, Homo sapiens
QVQLVQSGAEVKKPGASVKVSCKASGFDIQDTYMHWVRQAPGQGLEWMGRIEPASGHIKYSPKFQGRVTMTRDTSTSTVYMELSSLRSEDTAVYYCARSGGLPDWWGQGTTVTVSS

SEQ ID NO: 496 - protein, 106 aa, Homo sapiens
EIVLTQSPGTLSLSPGERATLSCGASSSVSYMYWYQQKPGQAPRLLIYATSNLASGIPDRFSGSGSGTDFTLTISRLEPEDFAVYYCQQWEGNPRTFGGGTKLEIK

SEQ ID NO: 497 - protein, 116 aa, Homo sapiens; identical to SEQ ID NO: 495

SEQ ID NO: 498 - protein, 106 aa, Homo sapiens; identical to SEQ ID NO: 492

SEQ ID NO: 499 - protein, 116 aa, Homo sapiens
QVQLVQSGAEVKKPGASVKVSCKASGFDIQDTYMHWVRQAPGQGLEWMGRIEPASGHVKYSPKFQVRVTMTRDTSTSTVYMELSSLRSEDTAVYYCARSGGLPDWWGQGTTVTVSS

SEQ ID NO: 500 - protein, 106 aa, Homo sapiens; identical to SEQ ID NO: 492

SEQ ID NO: 501 - protein, 116 aa, Homo sapiens
QVQLVQSGAEVKKPGASVKVSCKASGFDIQDTYMHWVRQAPGQGLEWMGRIEPASGHVKYDPKFQTRVTMTRDTSTSTVYMELSSLRSEDTAVYYCARSGGLPDWWGQGTTVTVSS

SEQ ID NO: 502 - protein, 106 aa, Homo sapiens
EIVLTQSPGTLSLSPGERATLSCRASSSVSYMYWYQQKPGQAPRLLIYATSNLASGIPDRFSGSGSGTDFTLTISRLEPEDFAVYYCQQWQGNPRTFGGGTKLEIK

SEQ ID NO: 503 - protein, 116 aa, Homo sapiens
QVQLVQSGAEVKKPGASVKVSCKASGFDIQDTYMHWVRQAPGQGLEWMGRIDPASGHIKYDPKFQKRVTMTRDTSTSTVYMELSSLRSEDTAVYYCARSGGLPDMWGQGTTVTVSS

SEQ ID NO: 504 - protein, 106 aa, Homo sapiens; identical to SEQ ID NO: 502

SEQ ID NO: 505 - protein, 116 aa, Homo sapiens
QVQLVQSGAEVKKPGASVKVSCKASGFDIQDTYMHWVRQAPGQGLEWMGRIDPASGHVKIDPKFQVRVTMTRDTSTSTVYMELSSLRSEDTAVYYCARSGGLPDMWGQGTTVTVSS

SEQ ID NO: 506 - protein, 106 aa, Homo sapiens; identical to SEQ ID NO: 502

SEQ ID NO: 507 - protein, 116 aa, Homo sapiens
QVQLVQSGAEVKKPGASVKVSCKASGFDIQDTYMHWVRQAPGQGLEWMGRIDPASGHLKYDPKFQVRVTMTRDTSTSTVYMELSSLRSEDTAVYYCARSGGLPDMWGQGTTVTVSS

SEQ ID NO: 508 - protein, 106 aa, Homo sapiens; identical to SEQ ID NO: 502

SEQ ID NO: 509 - protein, 116 aa, Homo sapiens
QVQLVQSGAEVKKPGASVKVSCKASGFDIQDTYMHWVRQAPGQGLEWMGRIDPASGHLKYDPKFQRRVTMTRDTSTSTVYMELSSLRSEDTAVYYCARSGGLPDMWGQGTTVTVSS

SEQ ID NO: 510 - protein, 106 aa, Homo sapiens; identical to SEQ ID NO: 492

SEQ ID NO: 511 - protein, 116 aa, Homo sapiens
QVQLVQSGAEVKKPGASVKVSCKASGFDIQDTYMHWVRQAPGQGLEWMGRIDPASGHLKYDPKFQNRVTMTRDTSTSTVYMELSSLRSEDTAVYYCARSGGLPDKWGQGTTVTVSS

SEQ ID NO: 512 - protein, 106 aa, Homo sapiens; identical to SEQ ID NO: 496

SEQ ID NO: 513 - protein, 116 aa, Homo sapiens; identical to SEQ ID NO: 511

SEQ ID NO: 514 - protein, 106 aa, Homo sapiens; identical to SEQ ID NO: 492

SEQ ID NO: 515 - protein, 116 aa, Homo sapiens
QVQLVQSGAEVKKPGASVKVSCKASGFDIQDTYMHWVRQAPGQGLEWMGRIEPASGHLKYDPKFQERVTMTRDTSTSTVYMELSSLRSEDTAVYYCARSGGLPDKWGQGTTVTVSS

SEQ ID NO: 516 - protein, 106 aa, Homo sapiens; identical to SEQ ID NO: 496

SEQ ID NO: 517 - protein, 116 aa, Homo sapiens; identical to SEQ ID NO: 515

SEQ ID NO: 518 - protein, 106 aa, Homo sapiens; identical to SEQ ID NO: 502

SEQ ID NO: 519 - protein, 116 aa, Homo sapiens
QVQLVQSGAEVKKPGASVKVSCKASGFDIQDTYMHWVRQAPGQGLEWMGRIDPASGHLKYDPKFQGRVTITRDTSASTAYMELSSLRSEDTAVYYCARSGGLPDMWGQGTTVTVSS

SEQ ID NO: 520 - protein, 106 aa, Homo sapiens; identical to SEQ ID NO: 502

SEQ ID NO: 521 - protein, 116 aa, Homo sapiens
QVQLVQSGAEVKKPGASVKVSCKASGFDIQDTYMHWVRQAPGQGLEWMGRIDPASGHLKYDPKFQGRVTITRDTSASTVYMELSSLRSEDTAVYYCARSGGLPDMWGQGTTVTVSS

SEQ ID NO: 522 - protein, 106 aa, Homo sapiens; identical to SEQ ID NO: 490

SEQ ID NO: 523 - protein, 116 aa, Homo sapiens
QVQLVQSGAEVKKPGASVKVSCKASGFDIQDTYMHWVRQAPGQGLEWMGRIDPASGHTKYDPKFQGRATITTDTSASTAYLQLSSLRSEDTAVYYCARSGGLPDVWGQGTTVTVSS

SEQ ID NO: 524 - protein, 106 aa, Homo sapiens; identical to SEQ ID NO: 490

SEQ ID NO: 525 - protein, 116 aa, Homo sapiens
QVQLVQSGAEVKKPGASVKVSCKASGFDIQDTYMHWVRQAPGQGLEWMGRIDPASGHTKYDPKFQVRATITTDTSASTAYLQLSSLRSEDTAVYYCARSGGLPDFWGQGTTVTVSS

SEQ ID NO: 526 - protein, 106 aa, Homo sapiens; identical to SEQ ID NO: 490

SEQ ID NO: 527 - protein, 116 aa, Homo sapiens
QVQLVQSGAEVKKPGASVKVSCKASGFDIQDTYMHWVRQAPGQGLEWMGRIDPASGHTKYDPKFQGRATITTDTSASTAYLQLSSLRSEDTAVYYCARSGGLPDFWGQGTTVTVSS

SEQ ID NO: 528 - protein, 106 aa, Homo sapiens; identical to SEQ ID NO: 490

SEQ ID NO: 529 - protein, 116 aa, Homo sapiens
QVQLVQSGAEVKKPGASVKVSCKASGFDIQDTYMHWVRQAPGQGLEWMGRIDPASGHTKYDPKFQGRATITTDTSASTAYLQLSSLRSEDTAVYYCARSGGLPDLWGQGTTVTVSS

SEQ ID NO: 530 - protein, 106 aa, Homo sapiens
EIVLTQSPGTLSLSPGERATLSCRASSSVSYMYWYQQKPGQAPRLLIYATSNLASGIPDRFSGSGSGTDFTLTISRLEPEDFAVYYCSQWSGNPRTFGGGTKLEIK

SEQ ID NO: 531 - protein, 116 aa, Homo sapiens; identical to SEQ ID NO: 527

SEQ ID NO: 532 - protein, 106 aa, Homo sapiens
EIVLTQSPGTLSLSPGERATLSCRASSSVSYMYWYQQKPGQAPRLLIYATSNLASGIPDRFSGSGSGTDFTLTISRLEPEDFAVYYCQQWSGNPRSFGGGTKLEIK

SEQ ID NO: 533 - protein, 116 aa, Homo sapiens; identical to SEQ ID NO: 527

SEQ ID NO: 534 - protein, 106 aa, Homo sapiens
EIVLTQSPGTLSLSPGERATLSCRASSSVSYMYWYQQKPGQAPRLLIYATSNLASGIPDRFSGSGSGTDFTLTISRLEPEDFAVYYCQQWSRNPRTFGGGTKLEIK

SEQ ID NO: 535 - protein, 116 aa, Homo sapiens; identical to SEQ ID NO: 527

SEQ ID NO: 536 - protein, 106 aa, Homo sapiens
EIVLTQSPGTLSLSPGERATLSCRASSSVSYMYWYQQKPGQAPRLLIYATSNLASGIPDRFSGSGSGTDFTLTISRLEPEDFAVYYCQQWKGNPRTFGGGTKLEIK

SEQ ID NO: 537 - protein, 116 aa, Homo sapiens; identical to SEQ ID NO: 527

SEQ ID NO: 538 - protein, 106 aa, Homo sapiens; identical to SEQ ID NO: 490

SEQ ID NO: 539 - protein, 116 aa, Homo sapiens
QVQLVQSGAEVKKPGASVKVSCKASGFDIQDTYMHWVRQAPGQGLEWMGRIDPASGHSKYDPKFQVRATITTDTSASTAYLQLSSLRSEDTAVYYCARSGGLPDFWGQGTTVTVSS

SEQ ID NO: 540 - protein, 106 aa, Homo sapiens; identical to SEQ ID NO: 490

SEQ ID NO: 541 - protein, 116 aa, Homo sapiens
QVQLVQSGAEVKKPGASVKVSCKASGFDIQDTYMHWVRQAPGQGLEWMGRIDPASGHYKYDPKFQVRATITTDTSASTAYLQLSSLRSEDTAVYYCARSGGLPDFWGQGTTVTVSS

SEQ ID NO: 542 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 543 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 544 - protein, 107 aa, Homo sapiens [sequence omitted]

SEQ ID NO: 545 - protein, 25 aa, Homo sapiens [sequence omitted]

SEQ ID NO: 546 - protein, 14 aa, Homo sapiens
WVRQAPGQGLEWMG

SEQ ID NO: 547 - protein, 30 aa, Homo sapiens
RVTMTRDTSTSTVYMELSSLRSEDTAVYYC

SEQ ID NO: 548 - protein, 11 aa, Homo sapiens
WGQGTTVTVSS

SEQ ID NO: 549 - protein, 23 aa, Homo sapiens
EIVLTQSPGTLSLSPGERATLSC

SEQ ID NO: 550 - protein, 15 aa, Homo sapiens
WYQQKPGQAPRLLIY

SEQ ID NO: 551 - protein, 32 aa, Homo sapiens
GIPDRFSGSGSGTDFTLTISRLEPEDFAVYYC

SEQ ID NO: 552 - protein, 10 aa, Homo sapiens
FGGGTKLEIK

SEQ ID NO: 553 - protein, 10 aa, Homo sapiens
GFDIQDTYMH

SEQ ID NO: 554 - protein, 17 aa, Homo sapiens
RIDPASGHTKYDPKFQV

SEQ ID NO: 555 - protein, 17 aa, Homo sapiens
RIEPASGHIKYDPKFQG

SEQ ID NO: 556 - protein, 17 aa, Homo sapiens
RIEPASGHIKYSPKFQG

SEQ ID NO: 557 - protein, 17 aa, Homo sapiens
RIEPASGHVKYSPKFQV

SEQ ID NO: 558 - protein, 17 aa, Homo sapiens
RIEPASGHVKYDPKFQT

SEQ ID NO: 559 - protein, 17 aa, Homo sapiens
RIDPASGHIKYDPKFQK

SEQ ID NO: 560 - protein, 17 aa, Homo sapiens
RIDPASGHVKIDPKFQV

SEQ ID NO: 561 - protein, 17 aa, Homo sapiens
RIDPASGHLKYDPKFQV

SEQ ID NO: 562 - protein, 17 aa, Homo sapiens
RIDPASGHLKYDPKFQR

SEQ ID NO: 563 - protein, 17 aa, Homo sapiens
RIDPASGHLKYDPKFQN

SEQ ID NO: 564 - protein, 17 aa, Homo sapiens
RIEPASGHLKYDPKFQE

SEQ ID NO: 565 - protein, 9 aa, Homo sapiens
ARSGGLPDV

SEQ ID NO: 566 - protein, 9 aa, Homo sapiens
ARSGGLPDW

SEQ ID NO: 567 - protein, 9 aa, Homo sapiens
ARSGGLPDM

SEQ ID NO: 568 - protein, 9 aa, Homo sapiens
ARSGGLPDK

SEQ ID NO: 569 - protein, 10 aa, Homo sapiens
RASSSVSYMY

SEQ ID NO: 570 - protein, 10 aa, Homo sapiens
GASSSVSYMY

SEQ ID NO: 571 - protein, 9 aa, Homo sapiens
QQWSGNPRT

SEQ ID NO: 572 - protein, 9 aa, Homo sapiens
QQWEGNPRT

SEQ ID NO: 573 - protein, 9 aa, Homo sapiens
QQWQGNPRT

SEQ ID NO: 574 - protein, 17 aa, Homo sapiens
RIDPASGHLKYDPKFQG

SEQ ID NO: 575 - protein, 17 aa, Homo sapiens
RIDPASGHTKYDPKFQG

SEQ ID NO: 576 - protein, 17 aa, Homo sapiens
RIDPASGHSKYDPKFQV

SEQ ID NO: 577 - protein, 17 aa, Homo sapiens
RIDPASGHYKYDPKFQV

SEQ ID NO: 578 - protein, 9 aa, Homo sapiens
ARSGGLPDV

SEQ ID NO: 579 - protein, 9 aa, Homo sapiens
ARSGGLPDM

SEQ ID NO: 580 - protein, 9 aa, Homo sapiens
ARSGGLPDF

SEQ ID NO: 581 - protein, 9 aa, Homo sapiens
ARSGGLPDL

SEQ ID NO: 582 - protein, 9 aa, Homo sapiens
SQWSGNPRT

SEQ ID NO: 583 - protein, 9 aa, Homo sapiens
QQWSGNPRS

SEQ ID NO: 584 - protein, 9 aa, Homo sapiens
QQWSRNPRT

SEQ ID NO: 585 - protein, 9 aa, Homo sapiens
QQWKGNPRT

SEQ ID NO: 586 - protein, 30 aa, Homo sapiens
RATITTDTSASTAYLQLSSLRSEDTAVYYC

SEQ ID NO: 587 - protein, 30 aa, Homo sapiens
RVTITRDTSASTVYMELSSLRSEDTAVYYC

SEQ ID NO: 588 - protein, 30 aa, Homo sapiens
RVTITRDTSASTAYMELSSLRSEDTAVYYC

SEQ ID NO: 589-1000 - skipped (412 entries)

SEQ ID NO: 1001 - DNA, 348 bp, Homo sapiens
gaagttcagctgcaacagtctggcgccgagctggttaagcctggcgcttctgtgaagctgagctgtaccgcctctggcttcgacatccaagacacctacatgcactgggtcaagcagaggcctgagcagggactcgagtggatcggcagaattgatcctgccagcggccacaccaaatacgaccccaagttccaagtgaaggccaccatcaccaccgacaccagcagcaataccgcctacctgcagctgagcagcctgacctctgaagataccgccgtgtactactgcagcagatctggcggactgcccgatgtttggggagccggaacaaccgtgacagtgtccagc

SEQ ID NO: 1002 - DNA, 348 bp, Homo sapiens
gaggttcaacttcaacaatcgggggccgagctggttaagcccggcgcttctgtaaaattgtcttgcactgcctctgggtttgacatccaagatacatatatgcattgggtgaaacagcgtcccgagcagggcttggagtggattggacgtattgaccccgcctctgggcacacgaaatatgatcctaagttccaggttaaagcgactatcacaacggacacctccagcaatacggcttatttacagttatcctcgctgacctctgaggatactgcagtgtactactgctctcgctctggtggtctgccagacgtgtggggtgcaggaactacagttactgtgtcttca

SEQ ID NO: 1003 - protein, 116 aa, Homo sapiens
EVQLQQSGAELVKPGASVKLSCTASGFDIQDTYMHWVKQRPEQGLEWIGRIDPASGHTKYDPKFQVKATITTDTSSNTAYLQLSSLTSEDTAVYYCSRSGGLPDVWGAGTTVTVSS

SEQ ID NO: 1004 - DNA, 318 bp, Homo sapiens
caaattgtgctgtctcagagccccgccatcctgagtgcttctccaggcgagaaagtgaccatgacctgcagagccagcagcagcgtgtcctacatgtactggtatcagcagaagcccggcagcagccccaagccttggatctacgccacaagcaatctggccagcggcgtgcccgatagattttctggctctggcagcggcaccagctacagcctgacaatctctagagtggaagccgaggatgccgccacctactactgtcaacagtggagcggcaaccccagaacctttggcggaggcaccaagctggaaatcaag

SEQ ID NO: 1005 - DNA, 318 bp, Homo sapiens
caaatcgtcctgtcacagtccccggcgatcctttctgcttcaccaggagagaaggtaaccatgacatgtcgcgcctcttcctcagtttcttacatgtactggtaccagcagaaaccaggatcatctcccaaaccctggatctacgctacatcaaaccttgcatctggcgtgccagaccgtttttcagggtcgggctcggggacttcctattcattaaccatttctcgcgtagaagcggaagacgccgccacgtattattgtcagcagtggtcaggaaatccgcgcacattcggaggcggaacgaaattggagatcaaa

SEQ ID NO: 1006 - protein, 106 aa, Homo sapiens
QIVLSQSPAILSASPGEKVTMTCRASSSVSYMYWYQQKPGSSPKPWIYATSNLASGVPDRFSGSGSGTSYSLTISRVEAEDAATYYCQQWSGNPRTFGGGTKLEIK

SEQ ID NO: 1007 - DNA, 30 bp, Homo sapiens
ggcttcgacatccaagacacctacatgcac

SEQ ID NO: 1008 - DNA, 30 bp, Homo sapiens
gggtttgacatccaagatacatatatgcat

SEQ ID NO: 1009 - protein, 10 aa, Homo sapiens
GFDIQDTYMH

SEQ ID NO: 1010-10009 - skipped (9000 entries)

SEQ ID NO: 10010 - DNA, 51 bp, Homo sapiens
agaattgatcctgccagcggccacaccaaatacgaccccaagttccaagtg

SEQ ID NO: 10011 - DNA, 51 bp, Homo sapiens
cgtattgaccccgcctctgggcacacgaaatatgatcctaagttccaggtt

SEQ ID NO: 10012 - protein, 17 aa, Homo sapiens
RIDPASGHTKYDPKFQV

SEQ ID NO: 10013 - DNA, 21 bp, Homo sapiens
tctggcggactgcccgatgtt

SEQ ID NO: 10014 - DNA, 21 bp, Homo sapiens
tctggtggtctgccagacgtg

SEQ ID NO: 10015 - protein, 7 aa, Homo sapiens
SGGLPDV

SEQ ID NO: 10016 - DNA, 30 bp, Homo sapiens
agagccagcagcagcgtgtcctacatgtac

SEQ ID NO: 10017 - DNA, 30 bp, Homo sapiens
cgcgcctcttcctcagtttcttacatgtac

SEQ ID NO: 10018 - protein, 10 aa, Homo sapiens
RASSSVSYMY

SEQ ID NO: 10019 - DNA, 21 bp, Homo sapiens
gccacaagcaatctggccagc

SEQ ID NO: 10020 - DNA, 21 bp, Homo sapiens
gctacatcaaaccttgcatct

SEQ ID NO: 10021 - protein, 7 aa, Homo sapiens
ATSNLAS

SEQ ID NO: 10022 - DNA, 27 bp, Homo sapiens
caacagtggagcggcaaccccagaacc

SEQ ID NO: 10023 - DNA, 27 bp, Homo sapiens
cagcagtggtcaggaaatccgcgcaca

SEQ ID NO: 10024 - protein, 9 aa, Homo sapiens
QQWSGNPRT

SEQ ID NO: 10025 - DNA, 348 bp, Homo sapiens
caagtacaattagtccagtcgggtgccgaggtaaaaaaacctggagcatccgtaaaactgtcttgcaaagcatcggggtttgacatccaggacacctacatgcactgggtgcgtcaagctccaggacagggattagagtggatgggtcgcatcgaccccgcgagcggacacacgaaatacgaccctaaatttcaagtacgtgtcacgatgactaccgacactagtacgagcactgtttatatggaattgtcctcgttacgctcagaggatacggcagtctattattgcagccgttccggaggcttacccgacgtctggggacagggaactactgtaacagtcagtagt

SEQ ID NO: 10026 - protein, 116 aa, Homo sapiens
QVQLVQSGAEVKKPGASVKLSCKASGFDIQDTYMHWVRQAPGQGLEWMGRIDPASGHTKYDPKFQVRVTMTTDTSTSTVYMELSSLRSEDTAVYYCSRSGGLPDVWGQGTTVTVSS

SEQ ID NO: 10027 - DNA, 318 bp, Homo sapiens
gagattgtgttaacgcaatcaccggggactttatcgctgtcgccgggggagcgcgttacaatgtcttgtcgcgcttcctcttcggtttcatacatgtattggtatcaacaaaaaccgggacaggctccacgcccctggatttacgctactagcaatttggcctcgggcgttcccgaccgcttcagcgggtcagggagcggcaccgattacacgttgaccatctctcgtctggaacctgaagacttcgcggtctattactgtcaacaatggtcgggaaatccccgtacatttggcggagggacgaagttggaaattaaa

SEQ ID NO: 10028 - protein, 106 aa, Homo sapiens
EIVLTQSPGTLSLSPGERVTMSCRASSSVSYMYWYQQKPGQAPRPWIYATSNLASGVPDRFSGSGSGTDYTLTISRLEPEDFAVYYCQQWSGNPRTFGGGTKLEIK

SEQ ID NO: 10029 - DNA, 30 bp, Homo sapiens
gggtttgacatccaggacacctacatgcac

SEQ ID NO: 10030 - DNA, 51 bp, Homo sapiens
cgcatcgaccccgcgagcggacacacgaaatacgaccctaaatttcaagta

SEQ ID NO: 10031 - DNA, 21 bp, Homo sapiens
tccggaggcttacccgacgtc

SEQ ID NO: 10032 - DNA, 36 bp, Homo sapiens
cgcgcttcctcttcggtttcatacatgtattggtat

SEQ ID NO: 10033 - DNA, 21 bp, Homo sapiens
gctactagcaatttggcctcg

SEQ ID NO: 10034 - DNA, 27 bp, Homo sapiens
caacaatggtcgggaaatccccgtaca

SEQ ID NO: 10035 - DNA, 348 bp, Homo sapiens
caagtacaattagtccagtcgggtgccgaggtaaaaaaacctggagcatccgtaaaactgtcttgcaaagcatcggggtttgacatccaggacacctacatgcactgggtgcgtcaagctccaggacagggattagagtggatgggtcgcatcgaccccgcgagcggacacacgaaatacgaccctaaatttcaagtacgtgtcacgatgactcgtgacactagtacgagcactgtttatatggaattgtcctcgttacgctcagaggatacggcagtctattattgcagccgttccggaggcttacccgacgtctggggacagggaactactgtaacagtcagtagt

SEQ ID NO: 10036 - protein, 116 aa, Homo sapiens
QVQLVQSGAEVKKPGASVKLSCKASGFDIQDTYMHWVRQAPGQGLEWMGRIDPASGHTKYDPKFQVRVTMTRDTSTSTVYMELSSLRSEDTAVYYCSRSGGLPDVWGQGTTVTVSS

SEQ ID NO: 10037 - DNA, 318 bp, Homo sapiens
gagattgtgttaacgcaatcaccggggactttatcgctgtcgccgggggagcgcgcgacactgtcttgtcgcgcttcctcttcggtttcatacatgtattggtatcaacaaaaaccgggacaggctccacgcctgctgatttacgctactagcaatttggcctcgggcatccccgaccgcttcagcgggtcagggagcggcaccgattttacgttgaccatctctcgtctggaacctgaagacttcgcggtctattactgtcaacaatggtcgggaaatccccgtacatttggcggagggacgaagttggaaattaaa

SEQ ID NO: 10038 - protein, 106 aa, Homo sapiens; identical to SEQ ID NO: 490

SEQ ID NO: 10039 - DNA, 348 bp, Homo sapiens
caagtacaattagtccagtcgggtgccgaggtaaaaaaacctggagcatccgtaaaagtctcttgcaaagcatcggggtttgacatccaggacacctacatgcactgggtgcgtcaagctccaggacagggattagagtggatgggtcgcatcgaccccgcgagcggacacacgaaatacgaccctaaatttcaagtacgtgtcacgatgactcgtgacactagtacgagcactgtttatatggaattgtcctcgttacgctcagaggatacggcagtctattattgcgcacgttccggaggcttacccgacgtctggggacagggaactactgtaacagtcagtagt

SEQ ID NO: 10040 - protein, 116 aa, Homo sapiens; identical to SEQ ID NO: 491

SEQ ID NO: 10041 - DNA, 318 bp, Homo sapiens
gagattgtgttaacgcaatcaccggggactttatcgctgtcgccgggggagcgcgcgacactgtcttgtcgcgcttcctcttcggtttcatacatgtattggtatcaacaaaaaccgggacaggctccacgcctgctgatttacgctactagcaatttggcctcgggcgttcccgaccgcttcagcgggtcagggagcggcaccgattacacgttgaccatctctcgtctggaacctgaagacttcgcggtctattactgtcaacaatggtcgggaaatccccgtacatttggcggagggacgaagttggaaattaaa

SEQ ID NO: 10042 - protein, 106 aa, Homo sapiens
EIVLTQSPGTLSLSPGERATLSCRASSSVSYMYWYQQKPGQAPRLLIYATSNLASGVPDRFSGSGSGTDYTLTISRLEPEDFAVYYCQQWSGNPRTFGGGTKLEIK

SEQ ID NO: 10043 - protein, 116 aa, Homo sapiens
QVQLVQSGAEVKKPGASVKVSCKASGFDIQDTYMHWVRQAPGQGLEWMGRIDPASGHTKYDPKFQVRVTMTRDTSTSTVYMELSSLRSEDTAVYYCARSGGLPDKWGQGTTVTVSS

SEQ ID NO: 10044 - protein, 116 aa, Homo sapiens
QVQLVQSGAEVKKPGASVKVSCKASGFDIQDTYMHWVRQAPGQGLEWMGRIDPASGHTKYDPKFQVRVTMTRDTSTSTVYMELSSLRSEDTAVYYCARSGGLPDMWGQGTTVTVSS

SEQ ID NO: 10045 - protein, 116 aa, Homo sapiens
QVQLVQSGAEVKKPGASVKVSCKASGFDIQDTYMHWVRQAPGQGLEWMGRIDPASGHTKYDPKFQVRVTMTRDTSTSTVYMELSSLRSEDTAVYYCARSGGLPDQWGQGTTVTVSS

SEQ ID NO: 10046 - protein, 116 aa, Homo sapiens
QVQLVQSGAEVKKPGASVKVSCKASGFDIQDTYMHWVRQAPGQGLEWMGRIDPASGHTKYDPKFQVRVTMTRDTSTSTVYMELSSLRSEDTAVYYCARSGGLPDWWGQGTTVTVSS

SEQ ID NO: 10047 - protein, 106 aa, Homo sapiens
EIVLTQSPGTLSLSPGERATLSCRASSSVSYMYWYQQKPGQAPRLLIYATSNLASGIPDRFSGSGSGTDFTLTISRLEPEDFAVYYCQQWDGNPRTFGGGTKLEIK

SEQ ID NO: 10048 - protein, 106 aa, Homo sapiens; identical to SEQ ID NO: 492

SEQ ID NO: 10049 - protein, 106 aa, Homo sapiens
EIVLTQSPGTLSLSPGERATLSCRASSSVSYMYWYQQKPGQAPRLLIYATSNLASGIPDRFSGSGSGTDFTLTISRLEPEDFAVYYCQQWHGNPRTFGGGTKLEIK

SEQ ID NO: 10050 - protein, 106 aa, Homo sapiens
EIVLTQSPGTLSLSPGERATLSCRASSSVSYMYWYQQKPGQAPRLLIYATSNLASGIPDRFSGSGSGTDFTLTISRLEPEDFAVYYCQQWNGNPRTFGGGTKLEIK

SEQ ID NO: 10051 - protein, 106 aa, Homo sapiens; identical to SEQ ID NO: 502

SEQ ID NO: 10052 - protein, 116 aa, Homo sapiens
  MOD_RES (28)..(28): Asp or Glu
  MOD_RES (29)..(29): Ile, Pro or Val
  MOD_RES (30)..(30): Gly, Gln, Ser or Val
  MOD_RES (33)..(33): Phe or Tyr
  MOD_RES (34)..(34): Ile or Met
  MOD_RES (102)..(102): Leu or Met
  MOD_RES (105)..(105): Glu, Ile, Lys, Leu, Met, Gln, Thr, Val, Trp or Tyr
QVQLVQSGAEVKKPGASVKVSCKASGFXXXDTXXHWVRQAPGQGLEWMGRIDPASGHTKYDPKFQVRVTMTRDTSTSTVYMELSSLRSEDTAVYYCARSGGXPDXWGQGTTVTVSS

SEQ ID NO: 10053 - protein, 106 aa, Homo sapiens
  MOD_RES (88)..(88): Gln or Asn
  MOD_RES (91)..(91): Asp, Glu, His, Asn, Gln or Ser
  MOD_RES (92)..(92): Ala or Gly
  MOD_RES (93)..(93): Asp, Phe, Lys, Asn, Arg, Ser or Thr
EIVLTQSPGTLSLSPGERATLSCRASSSVSYMYWYQQKPGQAPRLLIYATSNLASGIPDRFSGSGSGTDFTLTISRLEPEDFAVYYCXQWXXXPRTFGGGTKLEIK

SEQ ID NO: 10054 - protein, 116 aa, Homo sapiens
  MOD_RES (28)..(28): Asp or Glu
  MOD_RES (29)..(29): Ile, Pro or Val
  MOD_RES (30)..(30): Gly, Gln, Ser or Val
  MOD_RES (33)..(33): Phe or Tyr
  MOD_RES (34)..(34): Ile or Met
  MOD_RES (102)..(102): Leu or Met
  MOD_RES (105)..(105): Glu, Ile, Lys, Leu, Met, Gln, Thr, Val, Trp or Tyr
QVQLVQSGAEVKKPGASVKVSCKASGFXXXDTXXHWVRQAPGQGLEWMGRIDPASGHTKYDPKFQVRVTMTRDTSTSTVYMELSSLRSEDTAVYYCSRSGGXPDXWGQGTTVTVSS

SEQ ID NO: 10055-100099 - skipped (90045 entries)

SEQ ID NO: 100100 - protein, 25 aa, Homo sapiens
QVQLVQSGAEVKKPGASVKLSCKAS

SEQ ID NO: 100101 - protein, 14 aa, Homo sapiens
WVRQAPGQGLEWMG

SEQ ID NO: 100102 - protein, 32 aa, Homo sapiens
RVTMTRDTSTSTVYMELSSLRSEDTAVYYCSR

SEQ ID NO: 100103 - protein, 11 aa, Homo sapiens
WGQGTTVTVSS

SEQ ID NO: 100104 - protein, 23 aa, Homo sapiens
EIVLTQSPGTLSLSPGERATLSC

SEQ ID NO: 100105 - protein, 15 aa, Homo sapiens
WYQQKPGQAPRLLIY

SEQ ID NO: 100106 - protein, 32 aa, Homo sapiens; identical to SEQ ID NO: 551

SEQ ID NO: 100107 - protein, 10 aa, Homo sapiens
FGGGTKLEIK

SEQ ID NO: 100108 - protein, 25 aa, Homo sapiens [sequence omitted]

SEQ ID NO: 100109 - protein, 32 aa, Homo sapiens
RVTMTRDTSTSTVYMELSSLRSEDTAVYYCAR

SEQ ID NO: 100110 - protein, 32 aa, Homo sapiens
GVPDRFSGSGSGTDYTLTISRLEPEDFAVYYC

SEQ ID NO: 100111-100149 - skipped (39 entries)

SEQ ID NO: 100150 - protein, 10 aa, Homo sapiens
  MOD_RES (3)..(3): Asp or Glu
  MOD_RES (4)..(4): Ile, Pro or Val
  MOD_RES (5)..(5): Gly, Gln, Ser or Val
  MOD_RES (8)..(8): Phe or Tyr
  MOD_RES (9)..(9): Ile or Met
GFXXXDTXXH

SEQ ID NO: 100151 - skipped

SEQ ID NO: 100152 - protein, 7 aa, Homo sapiens
  MOD_RES (4)..(4): Leu or Met
  MOD_RES (7)..(7): Glu, Ile, Lys, Leu, Met, Gln, Thr, Val, Trp or Tyr
SGGXPDX

SEQ ID NO: 100153-100154 - skipped (2 entries)

SEQ ID NO: 100155 - protein, 9 aa, Homo sapiens
  MOD_RES (1)..(1): Gln or Asn
  MOD_RES (4)..(4): Asp, Glu, His, Asn, Gln or Ser
  MOD_RES (5)..(5): Ala or Gly
  MOD_RES (6)..(6): Asp, Phe, Lys, Asn, Arg, Ser or Thr
XQWXXXPRT

SEQ ID NO: 100156-100199 - skipped (44 entries)

SEQ ID NO: 100200 - protein, 10 aa, Homo sapiens
GFDIGDTFIH

SEQ ID NO: 100201 - protein, 10 aa, Homo sapiens
GFDIGDTFMH

SEQ ID NO: 100202 - protein, 10 aa, Homo sapiens
GFDIGDTYIH

SEQ ID NO: 100203 - protein, 10 aa, Homo sapiens
GFDIGDTYMH

SEQ ID NO: 100204 - protein, 10 aa, Homo sapiens
GFDIQDTFIH

SEQ ID NO: 100205 - protein, 10 aa, Homo sapiens
GFDIQDTFMH

SEQ ID NO: 100206 - protein, 10 aa, Homo sapiens
GFDIQDTYIH

SEQ ID NO: 100207 - protein, 10 aa, Homo sapiens
GFDIQDTYMH

SEQ ID NO: 100208 - protein, 10 aa, Homo sapiens
GFDISDTFIH

SEQ ID NO: 100209 - protein, 10 aa, Homo sapiens
GFDISDTFMH

SEQ ID NO: 100210 - protein, 10 aa, Homo sapiens
GFDISDTYIH

SEQ ID NO: 100211 - protein, 10 aa, Homo sapiens
GFDISDTYMH

SEQ ID NO: 100212 - protein, 10 aa, Homo sapiens
GFDIVDTFIH

SEQ ID NO: 100213 - protein, 10 aa, Homo sapiens
GFDIVDTFMH

SEQ ID NO: 100214 - protein, 10 aa, Homo sapiens
GFDIVDTYIH

SEQ ID NO: 100215 - protein, 10 aa, Homo sapiens
GFDIVDTYMH

SEQ ID NO: 100216 - protein, 10 aa, Homo sapiens
GFDPGDTFIH

SEQ ID NO: 100217 - protein, 10 aa, Homo sapiens
GFDPGDTFMH

SEQ ID NO: 100218 - protein, 10 aa, Homo sapiens
GFDPGDTYIH

SEQ ID NO: 100219 - protein, 10 aa, Homo sapiens
GFDPGDTYMH

SEQ ID NO: 100220 - protein, 10 aa, Homo sapiens
GFDPQDTFIH

SEQ ID NO: 100221 - protein, 10 aa, Homo sapiens
GFDPQDTFMH

SEQ ID NO: 100222 - protein, 10 aa, Homo sapiens
GFDPQDTYIH

SEQ ID NO: 100223 - protein, 10 aa, Homo sapiens
GFDPQDTYMH

SEQ ID NO: 100224 - protein, 10 aa, Homo sapiens
GFDPSDTFIH

SEQ ID NO: 100225 - protein, 10 aa, Homo sapiens
GFDPSDTFMH

SEQ ID NO: 100226 - protein, 10 aa, Homo sapiens
GFDPSDTYIH

SEQ ID NO: 100227 - protein, 10 aa, Homo sapiens
GFDPSDTYMH

SEQ ID NO: 100228 - protein, 10 aa, Homo sapiens
GFDPVDTFIH

SEQ ID NO: 100229 - protein, 10 aa, Homo sapiens
GFDPVDTFMH

SEQ ID NO: 100230 - protein, 10 aa, Homo sapiens
GFDPVDTYIH

SEQ ID NO: 100231 - protein, 10 aa, Homo sapiens
GFDPVDTYMH

SEQ ID NO: 100232 - protein, 10 aa, Homo sapiens
GFDVGDTFIH

SEQ ID NO: 100233 - protein, 10 aa, Homo sapiens
GFDVGDTFMH

SEQ ID NO: 100234 - protein, 10 aa, Homo sapiens
GFDVGDTYIH

SEQ ID NO: 100235 - protein, 10 aa, Homo sapiens
GFDVGDTYMH

SEQ ID NO: 100236 - protein, 10 aa, Homo sapiens
GFDVQDTFIH

SEQ ID NO: 100237 - protein, 10 aa, Homo sapiens
GFDVQDTFMH

SEQ ID NO: 100238 - protein, 10 aa, Homo sapiens
GFDVQDTYIH

SEQ ID NO: 100239 - protein, 10 aa, Homo sapiens
GFDVQDTYMH

SEQ ID NO: 100240 - protein, 10 aa, Homo sapiens
GFDVSDTFIH

SEQ ID NO: 100241 - protein, 10 aa, Homo sapiens
GFDVSDTFMH

SEQ ID NO: 100242 - protein, 10 aa, Homo sapiens
GFDVSDTYIH

SEQ ID NO: 100243 - protein, 10 aa, Homo sapiens
GFDVSDTYMH

SEQ ID NO: 100244 - protein, 10 aa, Homo sapiens
GFDVVDTFIH

SEQ ID NO: 100245 - protein, 10 aa, Homo sapiens
GFDVVDTFMH

SEQ ID NO: 100246 - protein, 10 aa, Homo sapiens
GFDVVDTYIH

SEQ ID NO: 100247 - protein, 10 aa, Homo sapiens
GFDVVDTYMH

SEQ ID NO: 100248 - protein, 10 aa, Homo sapiens
GFEIGDTFIH

SEQ ID NO: 100249 - protein, 10 aa, Homo sapiens
GFEIGDTFMH

SEQ ID NO: 100250 - protein, 10 aa, Homo sapiens
GFEIGDTYIH

SEQ ID NO: 100251 - protein, 10 aa, Homo sapiens
GFEIGDTYMH

SEQ ID NO: 100252 - protein, 10 aa, Homo sapiens
GFEIQDTFIH

SEQ ID NO: 100253 - protein, 10 aa, Homo sapiens
GFEIQDTFMH

SEQ ID NO: 100254 - protein, 10 aa, Homo sapiens
GFEIQDTYIH

SEQ ID NO: 100255 - protein, 10 aa, Homo sapiens
GFEIQDTYMH

SEQ ID NO: 100256 - protein, 10 aa, Homo sapiens
GFEISDTFIH

SEQ ID NO: 100257 - protein, 10 aa, Homo sapiens
GFEISDTFMH

SEQ ID NO: 100258 - protein, 10 aa, Homo sapiens
GFEISDTYIH

SEQ ID NO: 100259 - protein, 10 aa, Homo sapiens
GFEISDTYMH

SEQ ID NO: 100260 - protein, 10 aa, Homo sapiens
GFEIVDTFIH

SEQ ID NO: 100261 - protein, 10 aa, Homo sapiens
GFEIVDTFMH

SEQ ID NO: 100262 - protein, 10 aa, Homo sapiens
GFEIVDTYIH

SEQ ID NO: 100263 - protein, 10 aa, Homo sapiens
GFEIVDTYMH

SEQ ID NO: 100264 - protein, 10 aa, Homo sapiens
GFEPGDTFIH

SEQ ID NO: 100265 - protein, 10 aa, Homo sapiens
GFEPGDTFMH

SEQ ID NO: 100266 - protein, 10 aa, Homo sapiens
GFEPGDTYIH

SEQ ID NO: 100267 - protein, 10 aa, Homo sapiens
GFEPGDTYMH

SEQ ID NO: 100268 - protein, 10 aa, Homo sapiens
GFEPQDTFIH

SEQ ID NO: 100269 - protein, 10 aa, Homo sapiens
GFEPQDTFMH

SEQ ID NO: 100270 - protein, 10 aa, Homo sapiens
GFEPQDTYIH

SEQ ID NO: 100271 - protein, 10 aa, Homo sapiens
GFEPQDTYMH

SEQ ID NO: 100272 - protein, 10 aa, Homo sapiens
GFEPSDTFIH

SEQ ID NO: 100273 - protein, 10 aa, Homo sapiens
GFEPSDTFMH

SEQ ID NO: 100274 - protein, 10 aa, Homo sapiens
GFEPSDTYIH

SEQ ID NO: 100275 - protein, 10 aa, Homo sapiens
GFEPSDTYMH

SEQ ID NO: 100276 - protein, 10 aa, Homo sapiens
GFEPVDTFIH

SEQ ID NO: 100277 - protein, 10 aa, Homo sapiens
GFEPVDTFMH

SEQ ID NO: 100278 - protein, 10 aa, Homo sapiens
GFEPVDTYIH

SEQ ID NO: 100279 - protein, 10 aa, Homo sapiens
GFEPVDTYMH

SEQ ID NO: 100280 - protein, 10 aa, Homo sapiens
GFEVGDTFIH

SEQ ID NO: 100281 - protein, 10 aa, Homo sapiens
GFEVGDTFMH

SEQ ID NO: 100282 - protein, 10 aa, Homo sapiens
GFEVGDTYIH

SEQ ID NO: 100283 - protein, 10 aa, Homo sapiens
GFEVGDTYMH

SEQ ID NO: 100284 - protein, 10 aa, Homo sapiens
GFEVQDTFIH

SEQ ID NO: 100285 - protein, 10 aa, Homo sapiens
GFEVQDTFMH

SEQ ID NO: 100286 - protein, 10 aa, Homo sapiens
GFEVQDTYIH

SEQ ID NO: 100287 - protein, 10 aa, Homo sapiens
GFEVQDTYMH

SEQ ID NO: 100288 - protein, 10 aa, Homo sapiens
GFEVSDTFIH

SEQ ID NO: 100289 - protein, 10 aa, Homo sapiens
GFEVSDTFMH

SEQ ID NO: 100290 - protein, 10 aa, Homo sapiens
GFEVSDTYIH

SEQ ID NO: 100291 - protein, 10 aa, Homo sapiens
GFEVSDTYMH

SEQ ID NO: 100292 - protein, 10 aa, Homo sapiens
GFEVVDTFIH

SEQ ID NO: 100293 - protein, 10 aa, Homo sapiens
GFEVVDTFMH

SEQ ID NO: 100294 - protein, 10 aa, Homo sapiens
GFEVVDTYIH

SEQ ID NO: 100295 - protein, 10 aa, Homo sapiens
GFEVVDTYMH

SEQ ID NO: 100296 - protein, 7 aa, Homo sapiens
SGGLPDE

SEQ ID NO: 100297 - protein, 7 aa, Homo sapiens
SGGLPDI

SEQ ID NO: 100298 - protein, 7 aa, Homo sapiens
SGGLPDK

SEQ ID NO: 100299 - protein, 7 aa, Homo sapiens
SGGLPDL

SEQ ID NO: 100300 - protein, 7 aa, Homo sapiens
SGGLPDM

SEQ ID NO: 100301 - protein, 7 aa, Homo sapiens
SGGLPDQ

SEQ ID NO: 100302 - protein, 7 aa, Homo sapiens
SGGLPDT

SEQ ID NO: 100303 - protein, 7 aa, Homo sapiens
SGGLPDW

SEQ ID NO: 100304 - protein, 7 aa, Homo sapiens
SGGLPDY

SEQ ID NO: 100305 - protein, 7 aa, Homo sapiens
SGGMPDE

SEQ ID NO: 100306 - protein, 7 aa, Homo sapiens
SGGMPDI

SEQ ID NO: 100307 - protein, 7 aa, Homo sapiens
SGGMPDK

SEQ ID NO: 100308 - protein, 7 aa, Homo sapiens
SGGMPDL

SEQ ID NO: 100309 - protein, 7 aa, Homo sapiens
SGGMPDM

SEQ ID NO: 100310 - protein, 7 aa, Homo sapiens
SGGMPDQ

SEQ ID NO: 100311 - protein, 7 aa, Homo sapiens
SGGMPDT

SEQ ID NO: 100312 - protein, 7 aa, Homo sapiens
SGGMPDV

SEQ ID NO: 100313 - protein, 7 aa, Homo sapiens
SGGMPDW

SEQ ID NO: 100314 - protein, 7 aa, Homo sapiens
SGGMPDY

SEQ ID NO: 100315 - protein, 9 aa, Homo sapiens
QQWDADPRT

SEQ ID NO: 100316 - protein, 9 aa, Homo sapiens
QQWDAFPRT

SEQ ID NO: 100317 - protein, 9 aa, Homo sapiens
QQWDAKPRT

SEQ ID NO: 100318 - protein, 9 aa, Homo sapiens
QQWDANPRT

SEQ ID NO: 100319 - protein, 9 aa, Homo sapiens
QQWDARPRT

SEQ ID NO: 100320 - protein, 9 aa, Homo sapiens
QQWDASPRT

SEQ ID NO: 100321 - protein, 9 aa, Homo sapiens
QQWDATPRT

SEQ ID NO: 100322 - protein, 9 aa, Homo sapiens
QQWDGDPRT

SEQ ID NO: 100323 - protein, 9 aa, Homo sapiens
QQWDGFPRT

SEQ ID NO: 100324 - protein, 9 aa, Homo sapiens
QQWDGKPRT

SEQ ID NO: 100325 - protein, 9 aa, Homo sapiens
QQWDGNPRT

SEQ ID NO: 100326 - protein, 9 aa, Homo sapiens
QQWDGRPRT

SEQ ID NO: 100327 - protein, 9 aa, Homo sapiens
QQWDGSPRT

SEQ ID NO: 100328 - protein, 9 aa, Homo sapiens
QQWDGTPRT

SEQ ID NO: 100329 - protein, 9 aa, Homo sapiens
QQWEADPRT

SEQ ID NO: 100330 - protein, 9 aa, Homo sapiens
QQWEAFPRT

SEQ ID NO: 100331 - protein, 9 aa, Homo sapiens
QQWEAKPRT

SEQ ID NO: 100332 - protein, 9 aa, Homo sapiens
QQWEANPRT

SEQ ID NO: 100333 - protein, 9 aa, Homo sapiens
QQWEARPRT

SEQ ID NO: 100334 - protein, 9 aa, Homo sapiens
QQWEASPRT

SEQ ID NO: 100335 - protein, 9 aa, Homo sapiens
QQWEATPRT

SEQ ID NO: 100336 - protein, 9 aa, Homo sapiens
QQWEGDPRT

SEQ ID NO: 100337 - protein, 9 aa, Homo sapiens
QQWEGFPRT

SEQ ID NO: 100338 - protein, 9 aa, Homo sapiens
QQWEGKPRT

SEQ ID NO: 100339 - protein, 9 aa, Homo sapiens
QQWEGNPRT

SEQ ID NO: 100340 - protein, 9 aa, Homo sapiens
QQWEGRPRT

SEQ ID NO: 100341 - protein, 9 aa, Homo sapiens
QQWEGSPRT

SEQ ID NO: 100342 - protein, 9 aa, Homo sapiens
QQWEGTPRT

SEQ ID NO: 100343 - protein, 9 aa, Homo sapiens
QQWHADPRT

SEQ ID NO: 100344 - protein, 9 aa, Homo sapiens
QQWHAFPRT

SEQ ID NO: 100345 - protein, 9 aa, Homo sapiens
QQWHAKPRT

SEQ ID NO: 100346 - protein, 9 aa, Homo sapiens
QQWHANPRT

SEQ ID NO: 100347 - protein, 9 aa, Homo sapiens
QQWHARPRT

SEQ ID NO: 100348 - protein, 9 aa, Homo sapiens
QQWHASPRT

SEQ ID NO: 100349 - protein, 9 aa, Homo sapiens
QQWHATPRT

SEQ ID NO: 100350 - protein, 9 aa, Homo sapiens
QQWHGDPRT

SEQ ID NO: 100351 - protein, 9 aa, Homo sapiens
QQWHGFPRT

SEQ ID NO: 100352 - protein, 9 aa, Homo sapiens
QQWHGKPRT

SEQ ID NO: 100353 - protein, 9 aa, Homo sapiens
QQWHGNPRT

SEQ ID NO: 100354 - protein, 9 aa, Homo sapiens
QQWHGRPRT

SEQ ID NO: 100355 - protein, 9 aa, Homo sapiens
QQWHGSPRT

SEQ ID NO: 100356 - protein, 9 aa, Homo sapiens
QQWHGTPRT

SEQ ID NO: 100357 - protein, 9 aa, Homo sapiens
QQWNADPRT

SEQ ID NO: 100358 - protein, 9 aa, Homo sapiens
QQWNAFPRT

SEQ ID NO: 100359 - protein, 9 aa, Homo sapiens
QQWNAKPRT

SEQ ID NO: 100360 - protein, 9 aa, Homo sapiens
QQWNANPRT

SEQ ID NO: 100361 - protein, 9 aa, Homo sapiens
QQWNARPRT

SEQ ID NO: 100362 - protein, 9 aa, Homo sapiens
QQWNASPRT

SEQ ID NO: 100363 - protein, 9 aa, Homo sapiens
QQWNATPRT

SEQ ID NO: 100364 - protein, 9 aa, Homo sapiens
QQWNGDPRT

SEQ ID NO: 100365 - protein, 9 aa, Homo sapiens
QQWNGFPRT

SEQ ID NO: 100366 - protein, 9 aa, Homo sapiens
QQWNGKPRT

SEQ ID NO: 100367 - protein, 9 aa, Homo sapiens
QQWNGNPRT

SEQ ID NO: 100368 - protein, 9 aa, Homo sapiens
QQWNGRPRT

SEQ ID NO: 100369 - protein, 9 aa, Homo sapiens
QQWNGSPRT

SEQ ID NO: 100370 - protein, 9 aa, Homo sapiens
QQWNGTPRT

SEQ ID NO: 100371 - protein, 9 aa, Homo sapiens
QQWQADPRT

SEQ ID NO: 100372 - protein, 9 aa, Homo sapiens
QQWQAFPRT

SEQ ID NO: 100373 - protein, 9 aa, Homo sapiens
QQWQAKPRT

SEQ ID NO: 100374 - protein, 9 aa, Homo sapiens
QQWQANPRT

SEQ ID NO: 100375 - protein, 9 aa, Homo sapiens
QQWQARPRT

SEQ ID NO: 100376 - protein, 9 aa, Homo sapiens
QQWQASPRT

SEQ ID NO: 100377 - protein, 9 aa, Homo sapiens
QQWQATPRT

SEQ ID NO: 100378 - protein, 9 aa, Homo sapiens
QQWQGDPRT

SEQ ID NO: 100379 - protein, 9 aa, Homo sapiens
QQWQGFPRT

SEQ ID NO: 100380 - protein, 9 aa, Homo sapiens
QQWQGKPRT

SEQ ID NO: 100381 - protein, 9 aa, Homo sapiens
QQWQGNPRT

SEQ ID NO: 100382 - protein, 9 aa, Homo sapiens
QQWQGRPRT

SEQ ID NO: 100383 - protein, 9 aa, Homo sapiens
QQWQGSPRT

SEQ ID NO: 100384 - protein, 9 aa, Homo sapiens
QQWQGTPRT

SEQ ID NO: 100385 - protein, 9 aa, Homo sapiens
QQWSADPRT

SEQ ID NO: 100386 - protein, 9 aa, Homo sapiens
QQWSAFPRT

SEQ ID NO: 100387 - protein, 9 aa, Homo sapiens
QQWSAKPRT

SEQ ID NO: 100388 - protein, 9 aa, Homo sapiens
QQWSANPRT

SEQ ID NO: 100389 - protein, 9 aa, Homo sapiens
QQWSARPRT

SEQ ID NO: 100390 - protein, 9 aa, Homo sapiens
QQWSASPRT

SEQ ID NO: 100391 - protein, 9 aa, Homo sapiens
QQWSATPRT

SEQ ID NO: 100392 - protein, 9 aa, Homo sapiens
QQWSGDPRT

SEQ ID NO: 100393 - protein, 9 aa, Homo sapiens
QQWSGFPRT

SEQ ID NO: 100394 - protein, 9 aa, Homo sapiens
QQWSGKPRT

SEQ ID NO: 100395 - protein, 9 aa, Homo sapiens
QQWSGNPRT

SEQ ID NO: 100396 - protein, 9 aa, Homo sapiens
QQWSGRPRT

SEQ ID NO: 100397 - protein, 9 aa, Homo sapiens
QQWSGSPRT

SEQ ID NO: 100398 - protein, 9 aa, Homo sapiens
QQWSGTPRT

SEQ ID NO: 100399 - protein, 9 aa, Homo sapiens
QQWDADPRT

SEQ ID NO: 100400 - protein, 9 aa, Homo sapiens
NQWDAFPRT

SEQ ID NO: 100401 - protein, 9 aa, Homo sapiens
NQWDAKPRT

SEQ ID NO: 100402 - protein, 9 aa, Homo sapiens
NQWDANPRT

SEQ ID NO: 100403 - protein, 9 aa, Homo sapiens
NQWDARPRT

SEQ ID NO: 100404 - protein, 9 aa, Homo sapiens
NQWDASPRT

SEQ ID NO: 100405 - protein, 9 aa, Homo sapiens
NQWDATPRT

SEQ ID NO: 100406 - protein, 9 aa, Homo sapiens
NQWDGDPRT

SEQ ID NO: 100407 - protein, 9 aa, Homo sapiens
NQWDGFPRT

SEQ ID NO: 100408 - protein, 9 aa, Homo sapiens
NQWDGKPRT

SEQ ID NO: 100409 - protein, 9 aa, Homo sapiens
NQWDGNPRT

SEQ ID NO: 100410 - protein, 9 aa, Homo sapiens
NQWDGRPRT

SEQ ID NO: 100411 - protein, 9 aa, Homo sapiens
NQWDGSPRT

SEQ ID NO: 100412 - protein, 9 aa, Homo sapiens
NQWDGTPRT

SEQ ID NO: 100413 - protein, 9 aa, Homo sapiens
NQWEADPRT

SEQ ID NO: 100414 - protein, 9 aa, Homo sapiens
NQWEAFPRT

SEQ ID NO: 100415 - protein, 9 aa, Homo sapiens
NQWEAKPRT

SEQ ID NO: 100416 - protein, 9 aa, Homo sapiens
NQWEANPRT

SEQ ID NO: 100417 - protein, 9 aa, Homo sapiens
NQWEARPRT

SEQ ID NO: 100418 - protein, 9 aa, Homo sapiens
NQWEASPRT

SEQ ID NO: 100419 - protein, 9 aa, Homo sapiens
NQWEATPRT

SEQ ID NO: 100420 - protein, 9 aa, Homo sapiens
NQWEGDPRT

SEQ ID NO: 100421 - protein, 9 aa, Homo sapiens
NQWEGFPRT

SEQ ID NO: 100422 - protein, 9 aa, Homo sapiens
NQWEGKPRT

SEQ ID NO: 100423 - protein, 9 aa, Homo sapiens
NQWEGNPRT

SEQ ID NO: 100424 - protein, 9 aa, Homo sapiens
NQWEGRPRT

SEQ ID NO: 100425 - protein, 9 aa, Homo sapiens
NQWEGSPRT

SEQ ID NO: 100426 - protein, 9 aa, Homo sapiens
NQWEGTPRT

SEQ ID NO: 100427 - protein, 9 aa, Homo sapiens
NQWHADPRT

SEQ ID NO: 100428 - protein, 9 aa, Homo sapiens
NQWHAFPRT

SEQ ID NO: 100429 - protein, 9 aa, Homo sapiens
NQWHAKPRT

SEQ ID NO: 100430 - protein, 9 aa, Homo sapiens
NQWHANPRT

SEQ ID NO: 100431 - protein, 9 aa, Homo sapiens
NQWHARPRT

SEQ ID NO: 100432 - protein, 9 aa, Homo sapiens
NQWHASPRT

SEQ ID NO: 100433 - protein, 9 aa, Homo sapiens
NQWHATPRT

SEQ ID NO: 100434 - protein, 9 aa, Homo sapiens
NQWHGDPRT

SEQ ID NO: 100435 - protein, 9 aa, Homo sapiens
NQWHGFPRT

SEQ ID NO: 100436 - protein, 9 aa, Homo sapiens
NQWHGKPRT

SEQ ID NO: 100437 - protein, 9 aa, Homo sapiens
NQWHGNPRT

SEQ ID NO: 100438 - protein, 9 aa, Homo sapiens
NQWHGRPRT

SEQ ID NO: 100439 - protein, 9 aa, Homo sapiens
NQWHGSPRT

SEQ ID NO: 100440 - protein, 9 aa, Homo sapiens
NQWHGTPRT

SEQ ID NO: 100441 - protein, 9 aa, Homo sapiens
NQWNADPRT

SEQ ID NO: 100442 - protein, 9 aa, Homo sapiens
NQWNAFPRT

SEQ ID NO: 100443 - protein, 9 aa, Homo sapiens
NQWNAKPRT

SEQ ID NO: 100444 - protein, 9 aa, Homo sapiens
NQWNANPRT

SEQ ID NO: 100445 - protein, 9 aa, Homo sapiens
NQWNARPRT

SEQ ID NO: 100446 - protein, 9 aa, Homo sapiens
NQWNASPRT

SEQ ID NO: 100447 - protein, 9 aa, Homo sapiens
NQWNATPRT

SEQ ID NO: 100448 - protein, 9 aa, Homo sapiens
NQWNGDPRT

SEQ ID NO: 100449 - protein, 9 aa, Homo sapiens
NQWNGFPRT

SEQ ID NO: 100450 - protein, 9 aa, Homo sapiens
NQWNGKPRT

SEQ ID NO: 100451 - protein, 9 aa, Homo sapiens
NQWNGNPRT

SEQ ID NO: 100452 - protein, 9 aa, Homo sapiens
NQWNGRPRT

SEQ ID NO: 100453 - protein, 9 aa, Homo sapiens
NQWNGSPRT

SEQ ID NO: 100454 - protein, 9 aa, Homo sapiens
NQWNGTPRT

SEQ ID NO: 100455 - protein, 9 aa, Homo sapiens
NQWQADPRT

SEQ ID NO: 100456 - protein, 9 aa, Homo sapiens
NQWQAFPRT

SEQ ID NO: 100457 - protein, 9 aa, Homo sapiens
NQWQAKPRT

SEQ ID NO: 100458 - protein, 9 aa, Homo sapiens
NQWQANPRT

SEQ ID NO: 100459 - protein, 9 aa, Homo sapiens
NQWQARPRT

SEQ ID NO: 100460 - protein, 9 aa, Homo sapiens
NQWQASPRT

SEQ ID NO: 100461 - protein, 9 aa, Homo sapiens
NQWQATPRT

SEQ ID NO: 100462 - protein, 9 aa, Homo sapiens
NQWQGDPRT

SEQ ID NO: 100463 - protein, 9 aa, Homo sapiens
NQWQGFPRT

SEQ ID NO: 100464 - protein, 9 aa, Homo sapiens
NQWQGKPRT

SEQ ID NO: 100465 - protein, 9 aa, Homo sapiens
NQWQGNPRT

SEQ ID NO: 100466 - protein, 9 aa, Homo sapiens
NQWQGRPRT

SEQ ID NO: 100467 - protein, 9 aa, Homo sapiens
NQWQGSPRT

SEQ ID NO: 100468 - protein, 9 aa, Homo sapiens
NQWQGTPRT

SEQ ID NO: 100469 - protein, 9 aa, Homo sapiens
NQWSADPRT

SEQ ID NO: 100470 - protein, 9 aa, Homo sapiens
NQWSAFPRT

SEQ ID NO: 100471 - protein, 9 aa, Homo sapiens
NQWSAKPRT

SEQ ID NO: 100472 - protein, 9 aa, Homo sapiens
NQWSANPRT

SEQ ID NO: 100473 - protein, 9 aa, Homo sapiens
NQWSARPRT

SEQ ID NO: 100474 - protein, 9 aa, Homo sapiens
NQWSASPRT

SEQ ID NO: 100475 - protein, 9 aa, Homo sapiens
NQWSATPRT

SEQ ID NO: 100476 - protein, 9 aa, Homo sapiens
NQWSGDPRT

SEQ ID NO: 100477 - protein, 9 aa, Homo sapiens
NQWSGFPRT

SEQ ID NO: 100478 - protein, 9 aa, Homo sapiens
NQWSGKPRT

SEQ ID NO: 100479 - protein, 9 aa, Homo sapiens
NQWSGNPRT

SEQ ID NO: 100480 - protein, 9 aa, Homo sapiens
NQWSGRPRT

SEQ ID NO: 100481 - protein, 9 aa, Homo sapiens
NQWSGSPRT

SEQ ID NO: 100482 - protein, 9 aa, Homo sapiens
NQWSGTPRT

SEQ ID NO: 100483-200108 - skipped (99626 entries)

SEQ ID NO: 200109 - protein, 8 aa, Homo sapiens
GFTFSTYG

SEQ ID NO: 200110 - protein, 8 aa, Homo sapiens
ISGTGRTT

SEQ ID NO: 200111 - protein, 14 aa, Homo sapiens
TKERGDYYYGVFDY

SEQ ID NO: 200112 - protein, 6 aa, Homo sapiens
QTISSW

SEQ ID NO: 200113 - protein, 3 aa, Homo sapiens
AAS

SEQ ID NO: 200114 - protein, 8 aa, Homo sapiens
QQYHRSWT

SEQ ID NO: 200115 - protein, 121 aa, Homo sapiens
EVQLLESGGGLVQPGKSLRLSCAVSGFTFSTYGMNWVRQAPGKGLEWVSSISGTGRTTYHADSVQGRFTVSRDNSKNILYLQMNSLRADDTAVYFCTKERGDYYYGVFDYWGQGTLVTVSS

SEQ ID NO: 200116 - protein, 106 aa, Homo sapiens
DIQMTQSPSTLSASVGDRVTITCRASQTISSWLAWYQQTPEKAPKLLIYAASNLQSGVPSRFSGSGSGTEFTLTISSLQPDDFATYYCQQYHRSWTFGQGTKVEIT

SEQ ID NO: 200117 - protein, 8 aa, Homo sapiens
GFTFSSYW

SEQ ID NO: 200118 - protein, 8 aa, Homo sapiens
IKEDGSEK

SEQ ID NO: 200119 - protein, 15 aa, Homo sapiens
AREDYDSYYKYGMDV

SEQ ID NO: 200120 - protein, 12 aa, Homo sapiens
QSILYSSNNKNY

SEQ ID NO: 200121 - protein, 3 aa, Homo sapiens
WAS

SEQ ID NO: 200122 - protein, 9 aa, Homo sapiens
QQYYSTPFT

SEQ ID NO: 200123 - protein, 122 aa, Homo sapiens
EVQLVESGGGLVQPGGSLRLSCAVSGFTFSSYWMSWVRQAPGKGLEWVANIKEDGSEKNYVDSVKGRFTLSSDNAKNSLYLQMNSLRAEDTAVYYCAREDYDSYYKYGMDVWGQGTAVIVSS

SEQ ID NO: 200124 - protein, 113 aa, Homo sapiens
DIVMTQSPDSLAVSLGERATINCKSSQSILYSSNNKNYLAWYQQKPGQPPKLLIYWASTRESGVPDRFSGSGSGTDFTLTISSLQAEDVSVYYCQQYYSTPFTFGPGTKVDIK

SEQ ID NO: 200125 - protein, 8 aa, Homo sapiens
GGSFTGFY

SEQ ID NO: 200126 - protein, 7 aa, Homo sapiens
INHRGNT

SEQ ID NO: 200127 - protein, 13 aa, Homo sapiens
ASPFYDFWSGSDY

SEQ ID NO: 200128 - protein, 11 aa, Homo sapiens
QSLVHSDGNTY

SEQ ID NO: 200129 - protein, 3 aa, Homo sapiens
KIS

SEQ ID NO: 200130 - protein, 9 aa, Homo sapiens
MQATQFPLT

SEQ ID NO: 200131 - protein, 119 aa, Homo sapiens
QVQLQQWGAGLLKPSETLSLTCAVYGGSFTGFYWSWIRQPPGKGLEWIGEINHRGNTNYNPSLKSRVTMSVDTSKNQFSLNMISVTAADTAMYFCASPFYDFWSGSDYWGQGTLVTVSS

SEQ ID NO: 200132 - protein, 112 aa, Homo sapiens
DIMLTQTPLTSPVTLGQPASISCKSSQSLVHSDGNTYLSWLQQRPGQPPRLLFYKISNRFSGVPDRFSGSGAGTDFTLKISRVEAEDVGVYYCMQATQFPLTFGGGTKVEIK

SEQ ID NO: 200133 - protein, 10 aa, Homo sapiens
  MOD_RES (3)..(3): Pro, Ser, Asp, Gln or Asn
  MOD_RES (5)..(5): Thr or Arg
  MOD_RES (6)..(6): Asn, Thr, Tyr or His
GYXFXXYGIS

SEQ ID NO: 200134 - protein, 17 aa, Homo sapiens
  MOD_RES (4)..(4): Thr, Pro, Ser or Ala
  MOD_RES (8)..(8): Asn, Gly, Val, Lys or Ala
  MOD_RES (9)..(9): Thr or Lys
  MOD_RES (10)..(10): His or Asn
  MOD_RES (13)..(13): Gln or Arg
  MOD_RES (14)..(14): Lys or Met
  MOD_RES (15)..(15): Leu or His
WISXYNGXXXYAXXXQG

SEQ ID NO: 200135 - protein, 15 aa, Homo sapiens
  MOD_RES (8)..(8): Ser or Ala
  MOD_RES (9)..(9): Tyr or Pro
  MOD_RES (15)..(15): Val, Ala or Gly
ENYYGSGXXRGGMDX

SEQ ID NO: 200136 - protein, 10 aa, Homo sapiens
GYDFTYYGIS

SEQ ID NO: 200137 - protein, 17 aa, Homo sapiens
WISTYNGNTHYARMLQG

SEQ ID NO: 200138 - protein, 15 aa, Homo sapiens
ENYYGSGAYRGGMDV

SEQ ID NO: 200139 - protein, 11 aa, Homo sapiens
RASQSVSSYLA

SEQ ID NO: 200140 - protein, 7 aa, Homo sapiens
DASNRAT

SEQ ID NO: 200141 - protein, 9 aa, Homo sapiens
QQRSNWPWT

SEQ ID NO: 200142 - protein, 124 aa, Homo sapiens
QVQLVQSGAEVKKPGASVKVSCKASGYDFTYYGISWVRQAPGQGLEWMGWISTYNGNTHYARMLQGRVTMTTDTSTRTAYMELRSLRSDDTAVYYCARENYYGSGAYRGGMDVWGQGTTVTVSS

SEQ ID NO: 200143 - protein, 107 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPWTFGQGTKVEIK

SEQ ID NO: 200144 - protein, 453 aa, Homo sapiens
QVQLVQSGAEVKKPGASVKVSCKASGYDFTYYGISWVRQAPGQGLEWMGWISTYNGNTHYARMLQGRVTMTTDTSTRTAYMELRSLRSDDTAVYYCARENYYGSGAYRGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 200145 - protein, 214 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 200146 - protein, 7 aa, Homo sapiens
SRSYYWG

SEQ ID NO: 200147 - protein, 16 aa, Homo sapiens
SIYYNGRTYYNPSLKS

SEQ ID NO: 200148 - protein, 11 aa, Homo sapiens
EDYGDYGAFDI

SEQ ID NO: 200149 - protein, 11 aa, Homo sapiens
RASQGISSALA

SEQ ID NO: 200150 - protein, 7 aa, Homo sapiens
DASSLES

SEQ ID NO: 200151 - protein, 9 aa, Homo sapiens
QQFNSYPLT

SEQ ID NO: 200152 - protein, 121 aa, Homo sapiens
QLQLQESGPGLVKPSETLSLTCTVSGGSISSRSYYWGWIRQPPGKGLEWIGSIYYNGRTYYNPSLKSRVTISVDTSKNQFSLKLSSVTAADTAVYYCAREDYGDYGAFDIWGQGTMVTVSS

SEQ ID NO: 200153 - protein, 107 aa, Homo sapiens [sequence omitted]

SEQ ID NO: 200154 - protein, 7 aa, Homo sapiens
TSNMGVV

SEQ ID NO: 200155 - protein, 16 aa, Homo sapiens
HILWDDREYSNPALKS

SEQ ID NO: 200156 - protein, 14 aa, Homo sapiens
MSRNYYGSSYVMDY

SEQ ID NO: 200157 - protein, 10 aa, Homo sapiens
SASSSVNYMH

SEQ ID NO: 200158 - protein, 7 aa, Homo sapiens
STSNLAS

SEQ ID NO: 200159 - protein, 8 aa, Homo sapiens
HQWNNYGT

SEQ ID NO: 200160 - protein, 124 aa, Homo sapiens
QVTLKESGPALVKPTQTLTLTCTFSGFSLSTSNMGVVWIRQPPGKALEWLAHILWDDREYSNPALKSRLTISKDTSKNQVVLTMTNMDPVDTATYYCARMSRNYYGSSYVMDYWGQGTLVTVSS

SEQ ID NO: 200161 - protein, 106 aa, Homo sapiens
DIQLTQSPSFLSASVGDRVTITCSASSSVNYMHWYQQKPGKAPKLLIYSTSNLASGVPSRFSGSGSGTEFTLTISSLQPEDFATYYCHQWNNYGTFGQGTKVEIKR

SEQ ID NO: 200162 - protein, 5 aa, Homo sapiens
LYGMN

SEQ ID NO: 200163 - protein, 5 aa, Homo sapiens
NYGMN

SEQ ID NO: 200164 - protein, 17 aa, Homo sapiens
WINTYTGEPTYADDFKG

SEQ ID NO: 200165 - protein, 10 aa, Homo sapiens
DTAMDYAMAY

SEQ ID NO: 200166 - protein, 13 aa, Homo sapiens
DYGKYGDYYAMDY

SEQ ID NO: 200167 - protein, 16 aa, Homo sapiens
KSSQNIVHSDGNTYLE

SEQ ID NO: 200168 - protein, 16 aa, Homo sapiens
RSSQSIVHSNGNTYLD

SEQ ID NO: 200169 - protein, 7 aa, Homo sapiens
KVSNRFS

SEQ ID NO: 200170 - protein, 9 aa, Homo sapiens
FQGSHVPLT

SEQ ID NO: 200171 - protein, 119 aa, Homo sapiens
QVQLVQSGSELKKPGASVKVSCKASGYTFTLYGMNWVRQAPGQGLEWMGWINTYTGEPTYADDFKGRFVFSLDTSVSTAYLQISSLKAEDTAVYYCARDTAMDYAMAYWGQGTLVTVSS

SEQ ID NO: 200172 - protein, 119 aa, Homo sapiens
QVQLVQSGSELKKPGASVKVSCKASGYTFTLYGMNWVKQAPGKGLKWMGWINTYTGEPTYADDFKGRFVFSLDTSVSTAYLQISSLKAEDTAVYFCARDTAMDYAMAYWGQGTLVTVSS

SEQ ID NO: 200173 - protein, 122 aa, Homo sapiens
QVQLVQSGSELKKPGASVKVSCKASGYTFTNYGMNWVRQAPGQGLEWMGWINTYTGEPTYADDFKGRFVFSLDTSVSTAYLQISSLKAEDTAVYYCARDYGKYGDYYAMDYWGQGTLVTVSS

SEQ ID NO: 200174 - protein, 122 aa, Homo sapiens
QVQLVQSGSELKKPGASVKVSCKASGYTFTNYGMNWVRQAPGKGLKWMGWINTYTGEPTYADDFKGRFVFSLDTSVSTAYLQISSLKAEDTAVYFCARDYGKYGDYYAMDYWGQGTLVTVSS

SEQ ID NO: 200175 - protein, 113 aa, Homo sapiens
DVVMTQSPLSLPVTLGQPASISCKSSQNIVHSDGNTYLEWFQQRPGQSPRRLIYKVSNRFSGVPDRFSGSGSGTDFTLKISRVEAEDVGVYYCFQGSHVPLTFGGGTKVEIKR

SEQ ID NO: 200176 - protein, 113 aa, Homo sapiens
DVVMTQSPLSLPVTLGQPASISCKSSQNIVHSDGNTYLEWFQQRPGQSPRRLIYKVSNRFSGVPDRFSGSGSGTDFTLKISRVEAEDVGVYYCFQGSHVPLTFGQGTKVEIKR

SEQ ID NO: 200177 - protein, 113 aa, Homo sapiens
DVVMTQTPLSLPVTPGEPASISCKSSQNIVHSDGNTYLEWYLQKPGQSPQLLIYKVSNRFSGVPDRFSGSGSGTDFTLKISRVEAEDLGVYYCFQGSHVPLTFGGGTKVEIKR

SEQ ID NO: 200178 - protein, 113 aa, Homo sapiens
DVVMTQTPLSLPVSLGDQASISCKSSQNIVHSDGNTYLEWYLQKPGQSPKVLIYKVSNRFSGVPDRFSGSGSGTDFTLKISRVEAEDLGVYYCFQGSHVPLTFGGGTKVEIKR

SEQ ID NO: 200179 - protein, 113 aa, Homo sapiens
DVVMTQSPLSLPVTLGQPASISCRSSQSIVHSNGNTYLDWFQQRPGQSPRRLIYKVSNRFSGVPDRFSGSGSGTDFTLKISRVEAEDVGVYYCFQGSHVPLTFGGGTKVEIKR

SEQ ID NO: 200180 - protein, 113 aa, Homo sapiens
DVVMTQSPLSLPVTLGQPASISCRSSQSIVHSNGNTYLDWFQQRPGQSPRRLIYKVSNRFSGVPDRFSGSGSGTDFTLKISRVEAEDVGVYYCFQGSHVPLTFGQGTKVEIKR

SEQ ID NO: 200181 - protein, 113 aa, Homo sapiens
DVVMTQTPLSLPVTPGEPASISCRSSQSIVHSNGNTYLDWYLQKPGQSPQLLIYKVSNRFSGVPDRFSGSGSGTDFTLKISRVEAEDLGVYYCFQGSHVPLTFGGGTKVEIKR

SEQ ID NO: 200182 - protein, 113 aa, Homo sapiens
DVVMTQTPLSLPVSLGDQASISCRSSQSIVHSNGNTYLDWYLQKPGQSPKVLIYKVSNRFSGVPDRFSGSGSGTDFTLKINRVEAEDLGVYFCFQGSHVPLTFGGGTKLEIKR

SEQ ID NO: 200183 - protein, 10 aa, Homo sapiens
GYTFTSSWMH

SEQ ID NO: 200184 - protein, 8 aa, Homo sapiens
IHPNSGGT

SEQ ID NO: 200185 - protein, 14 aa, Homo sapiens
ARGDYYGYVSWFAY

SEQ ID NO: 200186 - protein, 6 aa, Homo sapiens
QNINVL

SEQ ID NO: 200187 - protein, 3 aa, Homo sapiens
KAS

SEQ ID NO: 200188 - protein, 9 aa, Homo sapiens
QQGQSYPYT

SEQ ID NO: 200189 - protein, 119 aa, Homo sapiens
QVQLQQPGSVLVRPGASVKVSCKASGYTFTSSWMHWAKQRPGQGLEWIGEIHPNSGGTNYNEKFKGKATVDTSSSTAYVDLSSLTSEDSAVYYCARGDYYGYVSWFAYWGQGTLVTVSS

SEQ ID NO: 200190 - protein, 121 aa, Homo sapiens
QVQLVQSGAEVKKPGASVKVSCKASGYTFTSSWMHWARQAPGQGLEWIGEIHPNSGGTNYAQKFQGRATLTVDTSSSTAYMELSRLRSDDTAVYYCARGDYYGYVSWFAYWGQGTLVTVSS

SEQ ID NO: 200191 - protein, 121 aa, Homo sapiens
QVQLVQSGAEVKKPGASVKVSCKASGYTFTSSWMHWARQAPGQGLEWIGEIHPNSGGTNYAQKFQGRATMTVDTSISTAYMELSRLRSDDTAVYYCARGDYYGYVSWFAYWGQGTLVTVSS

SEQ ID NO: 200192 - protein, 121 aa, Homo sapiens
QVQLVQSGAEVKKPGASVKVSCKASGYTFTSSWMHWARQAPGQGLEWIGEIHPNSGGTNYAQKFQGRVTMTVDTSISTAYMELSRLRSDDTAVYYCARGDYYGYVSWFAYWGQGTLVTVSS

SEQ ID NO: 200193 - protein, 121 aa, Homo sapiens
QVQLVQSGAEVKKPGASVKVSCKASGYTFTSSWMHWARQAPGQGLEWMGEIHPNSGGTNYAQKFQGRVTMTVDTSISTAYMELSRLRSDDTAVYYCARGDYYGYVSWFAYWGQGTLVTVSS

SEQ ID NO: 200194 - protein, 107 aa, Homo sapiens
DIQMNQSPSSLSASLGDTITITCHASQNINVLLSWYQQKPGNIPKLLIYKASNLHTGVPSRFSGSGSGTGFTFTISSLQPEDIATYYCQQGQSYPYTFGGGTKLEIK

SEQ ID NO: 200195 - protein, 107 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCQQYDNLPYTFGQGTKLEIK

SEQ ID NO: 200196 - protein, 107 aa, Homo sapiens
DIQMTQSPSSLSASVGDRVTITCQASQNINVLLNWYQQKPGKAPKLLIYKASNLHTGVPSRFSGSGSGTDFTFTISSLQPEDIATYYCQQGQSYPYTFGQGTKLEIK

SEQ ID NO: 200197 - protein, 107 aa, Homo sapiens
DIQMNQSPSSLSASVGDRVTITCQASQNINVLLSWYQQKPGKAPKLLIYKASNLHTGVPSRFSGSGSGTDFTFTISSLQPEDIATYYCQQGQSYPYTFGQGTKLEIK

SEQ ID NO: 200198 - protein, 10 aa, Homo sapiens
GYTFTSYDIN

SEQ ID NO: 200199 - protein, 10 aa, Homo sapiens
  MOD_RES (8)..(8): Asn or Tyr
WLNPNSGXTG

SEQ ID NO: 200200 - protein, 10 aa, Homo sapiens
EVPETAAFEY

SEQ ID NO: 200201 - protein, 14 aa, Homo sapiens
  MOD_RES (10)..(10): Gly or Ala
  MOD_RES (11)..(11): Leu, Ser or Gln
  MOD_RES (14)..(14): His or Leu
TSSSSDIGAXXGVX

SEQ ID NO: 200202 - protein, 7 aa, Homo sapiens
GYYNRPS

SEQ ID NO: 200203 - protein, 10 aa, Homo sapiens
  MOD_RES (3)..(3): Tyr, Trp or Phe
QSXDGTLSAL

SEQ ID NO: 200204 - protein, 119 aa, Homo sapiens
QVQLVQSGAEVKKPGASVKVSCKASGYTFTSYDINWVRQAPGQGLEWMGWLNPNSGNTGYAQKFQGRVTMTADRSTSTAYMELSSLRSEDTAVYYCAREVPETAAFEYWGQGTLVTVSS

SEQ ID NO: 200205 - protein, 111 aa, Homo sapiens
  MOD_RES (32)..(33): Any amino acid
  MOD_RES (36)..(36): Any amino acid
  MOD_RES (93)..(93): Any amino acid
QSVLTQPPSVSGAPGQRVTISCTSSSSDIGAXXGVXWYQQLPGTAPKLLIEGYYNRPSGVPDRFSGSKSGTSASLTITGLLPEDEGDYYCQSXDGTLSALFGGGTKLTVLG

SEQ ID NO: 200206 - protein, 119 aa, Homo sapiens; identical to SEQ ID NO: 200204

SEQ ID NO: 200207 - protein, 111 aa, Homo sapiens
QSVLTQPPSVSGAPGQRVTISCTSSSSDIGAGLGVHWYQQLPGTAPKLLIEGYYNRPSGVPDRFSGSKSGTSASLTITGLLPEDEGDYYCQSWDGTLSALFGGGTKLTVLG

SEQ ID NO: 200208 - protein, 119 aa, Homo sapiens
QVQLVQSGAEVKKPGASVKVSCKASGYTFTSYDINWVRQAPGQGLEWMGWLNPNSGYTGYAQKFQGRVTMTADRSTSTAYMELSSLRSEDTAVYYCAREVPETAAFEYWGQGTLVTVSS

SEQ ID NO: 200209 - protein, 111 aa, Homo sapiens
QSVLTQPPSVSGAPGQRVTISCTSSSSDIGAGLGVHWYQQLPGTAPKLLIEGYYNRPSGVPDRFSGSKSGTSASLTITGLLPEDEGDYYCQSYDGTLSALFGGGTKLTVLG

SEQ ID NO: 200210 - protein, 119 aa, Homo sapiens; identical to SEQ ID NO: 200204

SEQ ID NO: 200211 - protein, 111 aa, Homo sapiens
QSVLTQPPSVSGAPGQRVTISCTSSSSDIGAALGVHWYQQLPGTAPKLLIEGYYNRPSGVPDRFSGSKSGTSASLTITGLLPEDEGDYYCQSWDGTLSALFGGGTKLTVLG

SEQ ID NO: 200212 - protein, 119 aa, Homo sapiens; identical to SEQ ID NO: 200204

SEQ ID NO: 200213 - protein, 111 aa, Homo sapiens
QSVLTQPPSVSGAPGQRVTISCTSSSSDIGAGSGVHWYQQLPGTAPKLLIEGYYNRPSGVPDRFSGSKSGTSASLTITGLLPEDEGDYYCQSWDGTLSALFGGGTKLTVLG

SEQ ID NO: 200214 - protein, 119 aa, Homo sapiens; identical to SEQ ID NO: 200204

SEQ ID NO: 200215 - protein, 111 aa, Homo sapiens
QSVLTQPPSVSGAPGQRVTISCTSSSSDIGAGQGVHWYQQLPGTAPKLLIEGYYNRPSGVPDRFSGSKSGTSASLTITGLLPEDEGDYYCQSWDGTLSALFGGGTKLTVLG

SEQ ID NO: 200216 - protein, 119 aa, Homo sapiens; identical to SEQ ID NO: 200204

SEQ ID NO: 200217 - protein, 111 aa, Homo sapiens
QSVLTQPPSVSGAPGQRVTISCTSSSSDIGAGLGVLWYQQLPGTAPKLLIEGYYNRPSGVPDRFSGSKSGTSASLTITGLLPEDEGDYYCQSWDGTLSALFGGGTKLTVLG

SEQ ID NO: 200218 - protein, 119 aa, Homo sapiens; identical to SEQ ID NO: 200208

SEQ ID NO: 200219 - protein, 111 aa, Homo sapiens; identical to SEQ ID NO: 200207

SEQ ID NO: 200220 - protein, 119 aa, Homo sapiens; identical to SEQ ID NO: 200208

SEQ ID NO: 200221 - protein, 111 aa, Homo sapiens; identical to SEQ ID NO: 200213

SEQ ID NO: 200222 - protein, 119 aa, Homo sapiens; identical to SEQ ID NO: 200208

SEQ ID NO: 200223 - protein, 111 aa, Homo sapiens; identical to SEQ ID NO: 200215

SEQ ID NO: 200224 - protein, 119 aa, Homo sapiens; identical to SEQ ID NO: 200208

SEQ ID NO: 200225 - protein, 111 aa, Homo sapiens; identical to SEQ ID NO: 200217

SEQ ID NO: 200226 - protein, 119 aa, Homo sapiens; identical to SEQ ID NO: 200208

SEQ ID NO: 200227 - protein, 111 aa, Homo sapiens
QSVLTQPPSVSGAPGQRVTISCTSSSSDIGAGLGVHWYQQLPGTAPKLLIEGYYNRPSGVPDRFSGSKSGTSASLTITGLLPEDEGDYYCQSFDGTLSALFGGGTKLTVLG

SEQ ID NO: 200228 - protein, 5 aa, Homo sapiens
SYFWS

SEQ ID NO: 200229 - protein, 16 aa, Homo sapiens
YIYYSGNTKYNPSLKS

SEQ ID NO: 200230 - protein, 10 aa, Homo sapiens
ETGSYYGFDY

SEQ ID NO: 200231 - protein, 11 aa, Homo sapiens
RASQSINNYLN

SEQ ID NO: 200232 - protein, 7 aa, Homo sapiens
AASSLQS

SEQ ID NO: 200233 - protein, 9 aa, Homo sapiens
QQSYSTPRT

SEQ ID NO: 200234 - protein, 118 aa, Homo sapiens
QVQLQESGPGLVKPSETLSLTCTVSGGSISSYFWSWIRQPPGKGLEWIGYIYYSGNTKYNPSLKSRVTISIDTSKNQFSLKLSSVTAADTAVYYCARETGSYYGFDYWGQGTLVTVSS

SEQ ID NO: 200235 - protein, 107 aa, Homo sapiens
DIQMTQSPSSLSASVGDRVTITCRASQSINNYLNWYQQRPGKAPKLLIYAASSLQSGVPSRFSGSGSGTDFTLTISSLQPGDFATYYCQQSYSTPRTFGQGTKLEIK

SEQ ID NO: 200236 - protein, 5 aa, Homo sapiens
GYYWN

SEQ ID NO: 200237 - protein, 16 aa, Homo sapiens
EINHAGNTNYNPSLKS

SEQ ID NO: 200238 - protein, 12 aa, Homo sapiens
GYCRSTTCYFDY

SEQ ID NO: 200239 - protein, 12 aa, Homo sapiens
RASQSVRSSYLA

SEQ ID NO: 200240 - protein, 7 aa, Homo sapiens
GASSRAT

SEQ ID NO: 200241 - protein, 8 aa, Homo sapiens
QQYGSSPT

SEQ ID NO: 200242 - protein, 120 aa, Homo sapiens
QVQLQQWGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSS

SEQ ID NO: 200243 - protein, 107 aa, Homo sapiens
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIK

SEQ ID NO: 200244 - protein, 116 aa, Homo sapiens; identical to SEQ ID NO: 1003

SEQ ID NO: 200245 - protein, 106 aa, Homo sapiens; identical to SEQ ID NO: 1006

SEQ ID NO: 200246 - protein, 10 aa, Homo sapiens
GFDIQDTYMH

SEQ ID NO: 200247 - protein, 17 aa, Homo sapiens
RIDPASGHTKYDPKFQV

SEQ ID NO: 200248 - protein, 7 aa, Homo sapiens
SGGLPDV

SEQ ID NO: 200249 - protein, 10 aa, Homo sapiens
RASSSVSYMY

SEQ ID NO: 200250 - protein, 7 aa, Homo sapiens
ATSNLAS

SEQ ID NO: 200251 - protein, 9 aa, Homo sapiens
QQWSGNPRT

SEQ ID NO: 200252 - protein, 116 aa, Homo sapiens; identical to SEQ ID NO: 10026

SEQ ID NO: 200253 - protein, 106 aa, Homo sapiens; identical to SEQ ID NO: 10028

SEQ ID NO: 200254 - protein, 116 aa, Homo sapiens; identical to SEQ ID NO: 10036

SEQ ID NO: 200255 - protein, 106 aa, Homo sapiens; identical to SEQ ID NO: 490

SEQ ID NO: 200256 - protein, 116 aa, Homo sapiens; identical to SEQ ID NO: 491

SEQ ID NO: 200257 - protein, 106 aa, Homo sapiens; identical to SEQ ID NO: 10042

SEQ ID NO: 200258 - protein, 121 aa, Homo sapiens
EVMLVESGGGLVKPGGSLKLSCAASGFTFTNYAMSWVRQTPEKRLEWVATITSGGSYIYYLDSVKGRFTISRDNAKSTLYLQMSSLRSEDTAIYNCARRKDGNYYYAMDYWGQGTSVTVSS

SEQ ID NO: 200259 - protein, 121 aa, Homo sapiens
EVMLVESGGGLVKPGGSLKLSCAASGFTFTNYAMSWVRQTPEKRLEWVATITSGGSYIYYLDSVKGRFTISRDNAKSTLYLQMSSLRSEDTAIYYCARRKDGNYYYAMDYWGQGTSVTVSS

SEQ ID NO: 200260 - protein, 121 aa, Homo sapiens
EVQLVESGGGLVKPGGSLRLSCAASGFTFTNYAMSWVRQAPGQRLEWVSTITSGGSYIYYLDSVKGRFTISRDNAKSTLYLQMNSLRAEDTAVYNCARRKDGNYYYAMDYWGQGTTVTVSS

SEQ ID NO: 200261 - protein, 121 aa, Homo sapiens
EVQLVESGGGLVKPGGSLRLSCAASGFTFTNYAMSWVRQAPGQRLEWVSTITSGGSYIYYLDSVKGRFTISRDNAKSTLYLQMNSLRAEDTAVYYCARRKDGNYYYAMDYWGQGTTVTVSS

SEQ ID NO: 200262 - protein, 121 aa, Homo sapiens
EVQLLESGGGLVQPGRSLRLSCAASGFTFTNYAMSWVRQAPGQRLEWLATITSGGSYIYYLDSVKGRFTISRDNSKSTLYLQMGSLRAEDMAVYNCARRKDGNYYYAMDYWGQGTTVTVSS

SEQ ID NO: 200263 - protein, 121 aa, Homo sapiens
EVQLLESGGGLVQPGRSLRLSCAASGFTFTNYAMSWVRQAPGQRLEWLATITSGGSYIYYLDSVKGRFTISRDNSKSTLYLQMGSLRAEDMAVYYCARRKDGNYYYAMDYWGQGTTVTVSS

SEQ ID NO: 200264 - protein, 121 aa, Homo sapiens
QVQLVESGGGLIQPGGSLRLSCAASGFTFTNYAMSWVRQARGQRLEWVSTITSGGSYIYYLDSVKGRFTISRDNSKSTLYMELSSLRSEDTAVYNCARRKDGNYYYAMDYWGQGTTVTVSS

SEQ ID NO: 200265 - protein, 121 aa, Homo sapiens
QVQLVESGGGLIQPGGSLRLSCAASGFTFTNYAMSWVRQARGQRLEWVSTITSGGSYIYYLDSVKGRFTISRDNSKSTLYMELSSLRSEDTAVYYCARRKDGNYYYAMDYWGQGTTVTVSS

SEQ ID NO: 200266 - protein, 121 aa, Homo sapiens
QVQLVQSGSELKKPGASVKVSCKASGFTFTNYAMSWVRQAPGKRLEWVSTITSGGSYIYYLDSVKGRFTISRENAKSTLYLQMNSLRTEDTALYNCARRKDGNYYYAMDYWGQGTTVTVSS

SEQ ID NO: 200267 - protein, 121 aa, Homo sapiens
QVQLVQSGSELKKPGASVKVSCKASGFTFTNYAMSWVRQAPGKRLEWVATITSGGSYIYYLDSVKGRFTISRENAKSTLYLQMNSLRTEDTALYYCARRKDGNYYYAMDYWGQGTTVTVSS

SEQ ID NO: 200268 - protein, 121 aa, Homo sapiens
EVQLLQSGAEVKKPGASVKVSCKASGFTFTNYAMSWVRQAPGQRLEWVATITSGGSYIYYLDSVKGRFTISRDNAKSTLHLQMNSLRAEDTAVYNCARRKDGNYYYAMDYWGQGTTVTVSS

SEQ ID NO: 200269 - protein, 121 aa, Homo sapiens
EVQLLQSGAEVKKPGASVKVSCKASGFTFTNYAMSWVRQAPGQRLEWVATITSGGSYIYYLDSVKGRFTISRDNAKSTLHLQMNSLRAEDTAIYYCARRKDGNYYYAMDYWGQGTTVTVSS

SEQ ID NO: 200270 - protein, 121 aa, Homo sapiens
EVMLLQSGAEVKKPGASVKVSCKASGFTFTNYAMSWVRQAPGQRLEWVATITSGGSYIYYLDSVKGRFTISRDNAKSTLHLQMNSLRAEDTAVYYCARRKDGNYYYAMDYWGQGTTVTVSS

SEQ ID NO: 200271 - protein, 111 aa, Homo sapiens
DIVLTQSPASLAVSLGQRATISCRASESVDSYGNSFIHWYQQKAGQPPKLLIYRASNLESGIPARFSGSGSRTDFTLTINPVEADDVATYYCQQSYEDPWTFGGGTKLEIK

SEQ ID NO: 200272 - protein, 111 aa, Homo sapiens
  MOD_RES (108)..(108): Any amino acid
DIVLTQSPATLSLSPGERATLSCRASESVDSYGNSFIHWYQQKPGQPPKLLIYRASNLESGIPARFSGSGSRTDFTLTISSLEPEDFAVYYCQQSYEDPWTFGGGTKXEIK

SEQ ID NO: 200273 - protein, 111 aa, Homo sapiens
  MOD_RES (108)..(108): Any amino acid
DIVLTQSPSSLSASVGDRVTITCRASESVDSYGNSFIHWYQQKPGQPPKLLIYRASNLESGIPARFSGSGSRTDFTLTISSLQPEDFATYYCQQSYEDPWTFGGGTKXEIK

SEQ ID NO: 200274 - protein, 111 aa, Homo sapiens
  MOD_RES (108)..(108): Any amino acid
DIVLTQSPDFQSVTPKEKVTITCRASESVDSYGNSFIHWYQQKPGQPPKLLIYRASNLESGIPARFSGSGSRTDFTLTISSLEAEDAATYYCQQSYEDPWTFGGGTKXEIK

SEQ ID NO: 200275 - protein, 111 aa, Homo sapiens
  MOD_RES (108)..(108): Any amino acid
DIVLTQTPLSLSVTPGQPASISCRASESVDSYGNSFIHWYQQKPGQPPKLLIYRASNLESGIPARFSGSGSRTDFTLKISRVEAEDVGVYYCQQSYEDPWTFGGGTKXEIK

SEQ ID NO: 200276 - protein, 5 aa, Homo sapiens
TYGMS

SEQ ID NO: 200277 - protein, 17 aa, Homo sapiens
WMNTYSGVTTYADDFKG

SEQ ID NO: 200278 - protein, 13 aa, Homo sapiens
EGYVFDDYYATDY

SEQ ID NO: 200279 - protein, 16 aa, Homo sapiens
RSSQNIVHSDGNTYLE

SEQ ID NO: 200280 - protein, 7 aa, Homo sapiens
KVSNRFS

SEQ ID NO: 200281 - protein, 9 aa, Homo sapiens
FQGSHVPLT

SEQ ID NO: 200282 - protein, 122 aa, Homo sapiens
QIQLVQSGPELKKPGETVKISCKASGYTFTTYGMSWVKQAPGKGLKWMGWMNTYSGVTTYADDFKGRFAFSLETSASTAYMQIDNLKNEDTATYFCAREGYVFDDYYATDYWGQGTSVTVSS

SEQ ID NO: 200283 - protein, 112 aa, Homo sapiens
DVLMTQTPLSLPVSLGDQASISCRSSQNIVHSDGNTYLEWYLQKPGQSPKLLIYKVSNRFSGVPDRFSGSGSGTDFTLKISRVEAEDLGIYYCFQGSHVPLTFGAGTKLELK

SEQ ID NO: 200284 - protein, 5 aa, Homo sapiens
KYDIN

SEQ ID NO: 200285 - protein, 17 aa, Homo sapiens
WIFPGDGRTDYNEKFKG

SEQ ID NO: 200286 - protein, 7 aa, Homo sapiens
YGPAMDY

SEQ ID NO: 200287 - protein, 16 aa, Homo sapiens
RSSQTIVHSNGDTYLD

SEQ ID NO: 200288 - protein, 7 aa, Homo sapiens
KVSNRFS

SEQ ID NO: 200289 - protein, 9 aa, Homo sapiens
FQGSHVPYT

SEQ ID NO: 200290 - protein, 135 aa, Homo sapiens
MGWSWVFLFLLSVTAGVHSQVHLQQSGPELVKPGASVKLSCKASGYTFTKYDINWVRQRPEQGLEWIGWIFPGDGRTDYNEKFKGKATLTTDKSSSTAYMEVSRLTSEDSAVYFCARYGPAMDYWGQGTSVTVAS

SEQ ID NO: 200291 - protein, 131 aa, Homo sapiens
MKLPVRLLVLMFWIPASSSDVLMTQTPLSLPVSLGDQASISCRSSQTIVHSNGDTYLDWFLQKPGQSPKLLIYKVSNRFSGVPDRFSGSGSGTDFTLKISRVEAEDLGVYYCFQGSHVPYTFGGGTKLEIK

What is claimed is:

1. A method of inhibiting or reducing CD30 ligand (CD30L) activity or expression in a subject having inflammatory bowel disease (IBD), the method comprising:
   a) identifying the subject as being a carrier of a genotype comprising a polymorphism at rs911605 and/or rs1006026, wherein the polymorphism at rs911605 has an "A" allele at nucleobase 501 within rs911605 (SEQ ID NO: 1), and wherein the polymorphism at rs1006026 has a "G" allele at nucleobase 501 within rs1006026 (SEQ ID NO: 3); and
   b) administering to the subject an effective amount of an inhibitor of CD30 ligand to inhibit or reduce the CD30 ligand activity or expression in the subject.

2. The method of claim 1, wherein the genotype comprises the polymorphism at rs911605, and the polymorphism at rs1006026.

3. The method of claim 1, wherein identifying the subject as being a carrier of the genotype comprises:
   a) contacting a sample obtained from the subject comprising genetic material with a nucleic acid sequence capable of hybridizing to at least 10 contiguous nucleobases between nucleobase 400 and nucleobase 600 of at least one of SEQ ID NO: 1 and SEQ ID NO: 3 under standard hybridization conditions, wherein the at least 10 contiguous nucleobases comprises nucleobase at position 501 of the at least one of SEQ ID NO: 1 and SEQ ID NO: 3; and
   b) detecting binding between the nucleic acid sequence and the at least 10 contiguous nucleobases between nucleobase 400 and nucleobase 600 of at least one of SEQ ID NO: 1 and SEQ ID NO: 3.

4. The method of claim 1, wherein the inhibitor of CD30 ligand is an antibody or an antigen-binding fragment targeting CD30 ligand or CD30, or a combination thereof.

5. The method of claim 1, wherein the inhibitor of CD30 ligand is an antibody or antigen-binding fragment thereof that specifically binds to CD30L, the antibody or antigen-binding fragment thereof comprising a heavy chain complementarity-determining region 1 (HCDR1), a heavy chain complementarity-determining region 2 (HCDR2), a heavy chain complementarity-determining region 3 (HCDR3), a light chain complementarity-determining region 1 (LCDR1), a light chain complementarity-determining region 2 (LCDR2), and a light chain complementarity-determining region 3 (LCDR3), wherein:
  a. the HCDR1 comprises SEQ ID NO: 100, the HCDR2 comprises SEQ ID NO: 101, the HCDR3 comprises SEQ ID NO: 102, the LCDR1 comprises SEQ ID NO: 103, the LCDR2 comprises SEQ ID NO: 104, and the LCDR3 comprises SEQ ID NO: 105;
  b. the HCDR1 comprises SEQ ID NO: 106, the HCDR2 comprises SEQ ID NO: 107, the HCDR3 comprises SEQ ID NO: 108, the LCDR1 comprises SEQ ID NO: 109, the LCDR2 comprises SEQ ID NO: 110, and the LCDR3 comprises SEQ ID NO: 111;
  c. the HCDR1 comprises SEQ ID NO: 112, the HCDR2 comprises SEQ ID NO: 113, the HCDR3 comprises SEQ ID NO: 114, the LCDR1 comprises SEQ ID NO: 115, the LCDR2 comprises SEQ ID NO: 116, and the LCDR3 comprises SEQ ID NO: 117;
  d. the HCDR1 comprises SEQ ID NO: 118, the HCDR2 comprises SEQ ID NO: 119, the HCDR3 comprises SEQ ID NO: 120, the LCDR1 comprises SEQ ID NO: 121, the LCDR2 comprises SEQ ID NO: 122, and the LCDR3 comprises SEQ ID NO: 123;
  e. the HCDR1 comprises SEQ ID NO: 124, the HCDR2 comprises SEQ ID NO: 125, the HCDR3 comprises SEQ ID NO: 126, the LCDR1 comprises SEQ ID NO: 127, the LCDR2 comprises SEQ ID NO: 128, and the LCDR3 comprises SEQ ID NO: 129; or
  f. the HCDR1 comprises SEQ ID NO: 130, the HCDR2 comprises SEQ ID NO: 131, the HCDR3 comprises SEQ ID NO: 132, the LCDR1 comprises SEQ ID NO: 133, the LCDR2 comprises SEQ ID NO: 134, and the LCDR3 comprises SEQ ID NO: 135.

6. The method of claim 1, wherein the inhibitor of CD30 ligand is an antibody or antigen-binding fragment thereof that specifically binds to CD30L, the antibody or antigen-binding fragment thereof comprising a heavy chain variable domain (HC) and a light chain variable domain (LC), wherein:
  a. the HC comprises SEQ ID NO: 136, and the LC comprises SEQ ID NO: 137;
  b. the HC comprises SEQ ID NO: 138, and the LC comprises SEQ ID NO: 139;
  c. the HC comprises SEQ ID NO: 140, and the LC comprises SEQ ID NO: 141;
  d. the HC comprises SEQ ID NO: 142, and the LC comprises SEQ ID NO: 143;
  e. the HC comprises SEQ ID NO: 144, and the LC comprises SEQ ID NO: 145;
  f. the HC comprises SEQ ID NO: 146, and the LC comprises SEQ ID NO: 154;
  g. the HC comprises SEQ ID NO: 147, and the LC comprises SEQ ID NO: 154;
  h. the HC comprises SEQ ID NO: 148, and the LC comprises SEQ ID NO: 154;
  i. the HC comprises SEQ ID NO: 149, and the LC comprises SEQ ID NO: 154;
  j. the HC comprises SEQ ID NO: 150, and the LC comprises SEQ ID NO: 154;
  k. the HC comprises SEQ ID NO: 151, and the LC comprises SEQ ID NO: 154;
  l. The HC comprises SEQ ID NO: 152, and the LC comprises SEQ ID NO: 154; or
  m. the HC comprises SEQ ID NO: 153, and the LC comprises SEQ ID NO: 154.

7. The method of claim 1, wherein the inhibitor of CD30 ligand is an antibody that specifically binds to CD30L, the antibody comprising a heavy chain complementarity-determining region 1 (HCDR1), a heavy chain complementarity-determining region 2 (HCDR2), a heavy chain complementarity-determining region 3 (HCDR3), a light chain complementarity-determining region 1 (LCDR1), a light chain complementarity-determining region 2 (LCDR2), and a light chain complementarity-determining region 3 (LCDR3), wherein:
  a. the HCDR1 comprises SEQ ID NO: 100, the HCDR2 comprises SEQ ID NO: 101, the HCDR3 comprises SEQ ID NO: 102, the LCDR1 comprises SEQ ID NO: 103, the LCDR2 comprises SEQ ID NO: 104, and the LCDR3 comprises SEQ ID NO: 105;
  b. the HCDR1 comprises SEQ ID NO: 106, the HCDR2 comprises SEQ ID NO: 107, the HCDR3 comprises SEQ ID NO: 108, the LCDRI comprises SEQ ID NO: 109, the LCDR2 comprises SEQ ID NO: 110, and the LCDR3 comprises SEQ ID NO: 111;
  c. the HCDR1 comprises SEQ ID NO: 112, the HCDR2 comprises SEQ ID NO: 113, the HCDR3 comprises SEQ ID NO: 114, the LCDRI comprises SEQ ID NO: 115, the LCDR2 comprises SEQ ID NO: 116, and the LCDR3 comprises SEQ ID NO: 117;
  d. the HCDR1 comprises SEQ ID NO: 118, the HCDR2 comprises SEQ ID NO: 119, the HCDR3 comprises SEQ ID NO: 120, the LCDR1 comprises SEQ ID NO: 121, the LCDR2 comprises SEQ ID NO: 122, and the LCDR3 comprises SEQ ID NO: 123;
  e. the HCDR1 comprises SEQ ID NO: 124, the HCDR2 comprises SEQ ID NO: 125, the HCDR3 comprises SEQ ID NO: 126, the LCDR1 comprises SEQ ID NO: 127, the LCDR2 comprises SEQ ID NO: 128, and the LCDR3 comprises SEQ ID NO: 129; or
  f. the HCDR1 comprises SEQ ID NO: 130, the HCDR2 comprises SEQ ID NO: 131, the HCDR3 comprises SEQ ID NO: 132, the LCDR1 comprises SEQ ID NO: 133, the LCDR2 comprises SEQ ID NO: 134, and the LCDR3 comprises SEQ ID NO: 135.

8. The method of claim 1, wherein the inhibitor of CD30 ligand is an antibody that specifically binds to CD30L, the antibody comprising a heavy chain variable domain (HC) and a light chain variable domain (LC), wherein:
  a. the HC comprises SEQ ID NO: 136, and the LC comprises SEQ ID NO: 137;
  b. the HC comprises SEQ ID NO: 138, and the LC comprises SEQ ID NO: 139;
  c. the HC comprises SEQ ID NO: 140, and the LC comprises SEQ ID NO: 141;
  d. the HC comprises SEQ ID NO: 142, and the LC comprises SEQ ID NO: 143;
  e. the HC comprises SEQ ID NO: 144, and the LC comprises SEQ ID NO: 145;
  f. the HC comprises SEQ ID NO: 146, and the LC comprises SEQ ID NO: 154;
  g. the HC comprises SEQ ID NO: 147, and the LC comprises SEQ ID NO: 154;
  h. the HC comprises SEQ ID NO: 148, and the LC comprises SEQ ID NO: 154;
  i. the HC comprises SEQ ID NO: 149, and the LC comprises SEQ ID NO: 154;

j. the HC comprises SEQ ID NO: 150, and the LC comprises SEQ ID NO: 154;
k. the HC comprises SEQ ID NO: 151, and the LC comprises SEQ ID NO: 154;
l. the HC comprises SEQ ID NO: 152, and the LC comprises SEQ ID NO: 154; or
m. the HC comprises SEQ ID NO: 153, and the LC comprises SEQ ID NO: 154.

* * * * *

UNITED STATES PATENT AND TRADEMARK OFFICE
CERTIFICATE OF CORRECTION

| | | |
|---|---|---|
| PATENT NO. | : 12,305,236 B2 | Page 1 of 1 |
| APPLICATION NO. | : 17/051731 | |
| DATED | : May 20, 2025 | |
| INVENTOR(S) | : Janine Bilsborough et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 1147 days.

Signed and Sealed this
Sixteenth Day of December, 2025

John A. Squires
*Director of the United States Patent and Trademark Office*